US009399775B2

(12) United States Patent
Rajeev et al.

(10) Patent No.: US 9,399,775 B2
(45) Date of Patent: Jul. 26, 2016

(54) RNAI AGENTS, COMPOSITIONS AND METHODS OF USE THEREOF FOR TREATING TRANSTHYRETIN (TTR) ASSOCIATED DISEASES

(71) Applicant: Alnylam Pharmaceuticals, Inc., Cambridge, MA (US)

(72) Inventors: Kallanthottathil G. Rajeev, Cambridge, MA (US); Tracy Zimmermann, Cambridge, MA (US); Muthiah Manoharan, Cambridge, MA (US); Martin Maier, Cambridge, MA (US); Satyanarayana Kuchimanchi, Cambridge, MA (US); Klaus Charisse, Cambridge, MA (US)

(73) Assignee: Alnylam Pharmaceuticals, Inc., Cambridge, MA (US)

( * ) Notice: Subject to any disclaimer, the term of this patent is extended or adjusted under 35 U.S.C. 154(b) by 0 days.

(21) Appl. No.: 14/358,972

(22) PCT Filed: Nov. 16, 2012

(86) PCT No.: PCT/US2012/065691
§ 371 (c)(1),
(2) Date: May 16, 2014

(87) PCT Pub. No.: WO2013/075035
PCT Pub. Date: May 23, 2013

(65) Prior Publication Data
US 2014/0315835 A1    Oct. 23, 2014

Related U.S. Application Data

(60) Provisional application No. 61/680,098, filed on Aug. 6, 2012, provisional application No. 61/615,618, filed on Mar. 26, 2012, provisional application No. 61/561,710, filed on Nov. 18, 2011.

(51) Int. Cl.
| | | |
|---|---|---|
| C12N 15/113 | (2010.01) | |
| C07H 21/02 | (2006.01) | |
| A61K 31/7125 | (2006.01) | |
| A61K 31/713 | (2006.01) | |

(52) U.S. Cl.
CPC .......... *C12N 15/1136* (2013.01); *A61K 31/713* (2013.01); *A61K 31/7125* (2013.01); *C07H 21/02* (2013.01); *C12N 15/113* (2013.01); *C12N 2310/14* (2013.01); *C12N 2310/315* (2013.01); *C12N 2310/343* (2013.01); *C12N 2310/346* (2013.01); *C12N 2310/351* (2013.01)

(58) Field of Classification Search
CPC .................... C12N 15/1136; C12N 2310/315; C12N 2310/321
See application file for complete search history.

(56) References Cited

U.S. PATENT DOCUMENTS

| | | |
|---|---|---|
| 7,250,496 B2 | 7/2007 | Bentwich |
| 7,427,605 B2 | 9/2008 | Davis et al. |
| 7,718,629 B2 | 5/2010 | Bumcrot et al. |
| 8,168,775 B2 | 5/2012 | Sah et al. |
| 8,741,866 B2 | 6/2014 | Sah et al. |
| 9,101,643 B2* | 8/2015 | Sah .................... A61K 31/7088 |
| 2002/0160394 A1 | 10/2002 | Wu |
| 2003/0072794 A1 | 4/2003 | Boulikas |
| 2003/0124616 A1 | 7/2003 | Jacobsen et al. |
| 2003/0143732 A1 | 7/2003 | Fosnaugh et al. |
| 2003/0170891 A1 | 9/2003 | McSwiggen |
| 2003/0191056 A1 | 10/2003 | Walker et al. |
| 2003/0229037 A1 | 12/2003 | Massing et al. |
| 2004/0119010 A1 | 6/2004 | Perryman et al. |
| 2004/0259247 A1 | 12/2004 | Tuschl et al. |
| 2005/0244869 A1 | 11/2005 | Brown-Driver et al. |
| 2005/0276804 A1 | 12/2005 | Smith et al. |
| 2006/0008910 A1 | 1/2006 | MacLachlan et al. |
| 2006/0083780 A1 | 4/2006 | Heyes et al. |
| 2006/0135460 A1 | 6/2006 | Widder et al. |
| 2006/0240093 A1 | 10/2006 | MacLachlan et al. |
| 2006/0263435 A1 | 11/2006 | Davis et al. |
| 2007/0004664 A1 | 1/2007 | McSwiggen et al. |
| 2007/0031844 A1 | 2/2007 | Khvorova et al. |
| 2007/0135372 A1 | 6/2007 | MacLachlan et al. |
| 2007/0207974 A1 | 9/2007 | Khvorova et al. |
| 2007/0281899 A1 | 12/2007 | Bumcrot et al. |
| 2008/0188675 A1 | 8/2008 | Chen et al. |
| 2009/0023215 A1 | 1/2009 | Jessee et al. |
| 2009/0023673 A1 | 1/2009 | Manoharan et al. |
| 2009/0082300 A1 | 3/2009 | Brown-Driver et al. |
| 2009/0149403 A1 | 6/2009 | MacLachlan et al. |

(Continued)

FOREIGN PATENT DOCUMENTS

| | | | |
|---|---|---|---|
| EP | 2305805 A1 | 4/2011 | |
| WO | WO-2004/015107 A2 | 2/2004 | |

(Continued)

OTHER PUBLICATIONS

Kawasaki et al. Tetrahedron Lett. 1999, 40:661-664.*
Agrawal S, et al., Antisense oligonucleotides: towards clinical trials. Trends in Biotechnology, Oct. 1996, vol. 14, pp. 376-387.
Akinc A., et al., A combinatorial library of lipid-like materials for delivery of RNAi therapeutics. Nature Biotechnology, 2008, vol. 26, pp. 561-569.
Ando Y., et al., "Pathogenesis and Therapy for Transthyretin Related Amyloidosis," Rinsho byori (the Japanese journal of clinical pathology), Feb. 2008, pp. 114-120, vol. 56 (With English Abstract).
Bass B., The short answer. Nature, May 24, 2001, pp. 428-429, vol. 411.
Benson M., et al., Targeted suppression of an amyloidogenic transthyretin with antisense oligonucleotides. Muscle & Nerve, Jan. 18, 2006, pp. 609-618, vol. 33, No. 5.

(Continued)

*Primary Examiner* — Brian Whiteman
(74) *Attorney, Agent, or Firm* — McCarter & English, LLP; Maria Laccotripe Zacharakis; Deborah L. Nagle

(57) ABSTRACT

The present invention provides RNAi agents, e.g., double stranded RNAi agents, that target the transthyretin (TTR) gene and methods of using such RNAi agents for treating or preventing TTR-associated diseases.

36 Claims, 16 Drawing Sheets

(56) References Cited

U.S. PATENT DOCUMENTS

| | | | |
|---|---|---|---|
| 2009/0239814 A1* | 9/2009 | Manoharan | A61K 47/48092 514/26 |
| 2009/0247608 A1 | 10/2009 | Manoharan et al. | |
| 2009/0291131 A1 | 11/2009 | MacLachlan et al. | |
| 2010/0120893 A1 | 5/2010 | Sah et al. | |
| 2010/0130588 A1 | 5/2010 | Yaworski et al. | |
| 2010/0167267 A1 | 7/2010 | Schulzknappe et al. | |
| 2010/0267069 A1 | 10/2010 | Kiernan et al. | |
| 2010/0323381 A1 | 12/2010 | Bergen, III et al. | |
| 2010/0324120 A1 | 12/2010 | Chen et al. | |
| 2011/0015250 A1 | 1/2011 | Bumcrot et al. | |
| 2011/0237646 A1 | 9/2011 | Smith et al. | |
| 2011/0294868 A1 | 12/2011 | Monia et al. | |
| 2012/0149109 A1 | 6/2012 | Brown-Driver et al. | |
| 2012/0225927 A1 | 9/2012 | Sah et al. | |
| 2012/0244207 A1 | 9/2012 | Fitzgerald et al. | |
| 2012/0294905 A1 | 11/2012 | Sah | |
| 2013/0217756 A1* | 8/2013 | Cancilla | C12N 15/111 514/44 A |
| 2013/0281510 A1 | 10/2013 | Ando et al. | |
| 2014/0194493 A1 | 7/2014 | Sah et al. | |

FOREIGN PATENT DOCUMENTS

| | | |
|---|---|---|
| WO | WO-2004/045543 A2 | 6/2004 |
| WO | WO-2004/080406 A2 | 9/2004 |
| WO | WO-2004/090108 A2 | 10/2004 |
| WO | WO-2005/120152 A2 | 12/2005 |
| WO | WO-2005/121370 A2 | 12/2005 |
| WO | WO-2007/012191 A1 | 2/2007 |
| WO | WO-2008/042973 A2 | 4/2008 |
| WO | WO-2009/002944 A2 | 12/2008 |
| WO | WO-2009/073809 A2 | 6/2009 |
| WO | WO-2009/086558 A1 | 7/2009 |
| WO | WO-2009/127060 A1 | 10/2009 |
| WO | WO-2009/134487 A2 | 11/2009 |
| WO | WO-2010/042877 A1 | 4/2010 |
| WO | WO-2010/048228 A2 | 4/2010 |
| WO | WO-2010/053572 A2 | 5/2010 |
| WO | WO-2010/054406 A1 | 5/2010 |
| WO | WO-2010/088537 A2 | 8/2010 |
| WO | WO-2010/129709 A1 | 11/2010 |
| WO | WO-2010/144740 A1 | 12/2010 |
| WO | WO-2010/147992 A1 | 12/2010 |
| WO | WO-2010/148013 A2 | 12/2010 |
| WO | WO2010148013 A2 * | 12/2010 |
| WO | WO-2011/056883 A1 | 5/2011 |
| WO | WO-2011/123468 A1 | 10/2011 |
| WO | WO-2012/037254 A1 | 3/2012 |
| WO | WO-2012/177906 A1 | 12/2012 |

OTHER PUBLICATIONS

Berquist J, et al., Rapid Method to Characterize Mutations in Transthyretin in Cerebrospinal Fluid from Familial Amyloidotic Polyneuropathy Patients by Use of Matrix-assisted Laser Desorption/Ionization Time-of-Flight Mass Spectrometry. Clinical Chem. 2000, 46(9):1293-1300.

Bramsen JB, et al., A Large-Scale Chemical Modification Screen Identifies Design Rules to Generate siRNAs with High Activity, High Stability and Low Toxicity, Nucleic Acids Res. 37(9):2867-2881 (2009).

Cendron L, et al., Amyloidogenic potential of transthyretin variants: insights from structural and computational analyses. J Biol Chem. Sep. 18, 2009;284(38):25832-41.

Collingwood MA., et al., Chemical Modification Patterns Compatible with High Potency Dicer-Substrate Small Interfering RNAs. Oliginucleotides, 18:187-200 (2008).

DeLeavey GF, et al., Synergistic Effects Between Analogs of DNA and RNA Improve the Potency of siRNA-Mediated Gene Silencing, Nucleic Acids Res. 38(13):4547-4557 (2010).

Elbashir S, et al., Analysis of gene function in somatic mammalian cells using small interfering RNAs. Methods, 2002 pp. 199-213, vol. 26.

Elbashir S, et al., Duplexes of 21-nucleotide RNAs mediate RNA interference in mammalian cell culture. Nature, May 24, 2001, pp. 494-498, vol. 411.

Elbashir S, et al., Functional Anatomy of siRNAs for Mediating Efficient RNAi in *Drosophila melanogaster* Embryo Lysate. The EMBO Journal, 2001, pp. 6877-6888, vol. 20, No. 23.

Elbashir S, et al., RNA Interference id Mediated by 21- and 22 Nucleotide RNAs. Genes & Development, 2001, pp. 188-200, vol. 15.

European Patent Office Communication pursuant to Article 94(3) EPC for European Patent Application No. 09 810 834.3, Feb. 15, 2012.

Examination Report for New Zealand Patent Application No. 592867, Jun. 14, 2011, 2 pages.

Fire A., at al., Potent and Specific Genetic Interference by Double Stranded RNA in Caenorhabditis elegans. Nature, Feb. 19, 1998, pp. 806-811, vol. 391.

Fire A., RNA-triggered Gene Silencing. Trends in Genetics, Sep. 1999, pp. 358-363, vol. 15, No. 9.

GenBank Accession No. NM_000371.2, *Homo sapiens* transthyretin (TTR), mRNA, Dec. 21, 2008.

GenBank Accession No. NM_000371.3, *Homo sapiens* transthyretin (TTR), mRNA, Sep. 23, 2012.

GenBank Accession No. NM_012681.1, Rattus norvegicus transthyretin (Ttr), mRNA, Feb. 14, 2010.

GenBank Accession No. NM_013697.2, Mus musculus transthyretin (Ttr), mRNA, Apr. 5, 2007.

Hara R, et al., Impact of Liver Transplantation on Transthyretin-Related Ocular Amyloidosis in Japanese Patients. Arch Ophthalmol, Feb. 2010, pp. 206-210, vol. 128, No. 2.

Heyes J., et al., Cationic lipid saturation influences intracellular delivery of encapsulated nucleic acids. Journal of Controlled Release, 2005, pp. 276-287, vol. 107.

Hornung V, et al., "Sequence-specific potent induction of IFN-α by short interfering RNA in plasmacytoid dendritic cells through TLR7". Nature Medicine, Mar. 2005, pp. 263-270, vol. 11, No. 3.

International Search Report for International Application No. PCT/US2012/065407 dated Apr. 22, 2013.

Judge A., et al., Confirming the RNAi-mediated mechanism of action of siRNA-based cancer therapeutics in mice. The Journal of Clinical Investigation, 2009 119(3): 661-673.

Kurosawa T., et al., Selective silencing of a mutant transthyretin allele by small interfering RNAs. Biochem. Biophys. Res. Commun., Nov. 25, 2005, vol. 337, No. 3, pp. 1012-1018.

Love K., et al., Lipid-like materials for low-dose, in vivo gene silencing. PNAS, Feb. 2, 2010, pp. 1864-1869, vol. 107, No. 5.

Maeda S., Use of genetically altered mice to study the role of serum amyloid P component in amyloid deposition. Amyloid, 2003, vol. 10, Suppl 1, pp. 17-20.

Morrissey D., et al., Potent and persistent in vivo anti-HBV activity of chemically modified siRNAs. Nature Biotechnology, Aug. 1, 2005, vol. 23, pp. 1002-1007.

PCT International Search Report and Written Opinion for International Patent Application No. PCT/US2009/061381, Jul. 26, 2010.

PCT International Search Report and Written Opinion for International Patent Application No. PCT/US2010/055311, Mar. 2, 2011, 12 pages.

PCT International Search Report and Written Opinion, PCT/US2011/030392, Jun. 27, 2011, 10 pages.

PCT Invitation to Pay Additional Fees and, Where Applicable, Protest Fee, PCT/US2009/061381, Apr. 27, 2010, 7 Pages.

Prakash TP, et al., Positional Effect of Cgemical Modifications on Short INterference RNA Activity in Mammalian Cells. J. Med. Chem. 48:4247-4253 (2005).

Reynolds, et al., Rational siRNA design for RNA interference. Nature Biotechnology, vol. 22, No. 3, pp. 326-330, 2004.

Robbins M., et al., Stable expression of shRNAs in human CD34 progenitor cells can avoid induction of interferon responses to siRNAs in vitro. Nature Biotechnology, May 2006, pp. 566-571, vol. 24, No. 5.

Rose S., et al., Functional polarity is introduced by Dicer processing of short substrate RNAs. Nucleic Acids Research, 2005, pp. 4140-4156, vol. 33, No. 13.

(56) References Cited

OTHER PUBLICATIONS

Schweigert FJ, et al., Characterization of the microheterogeneity of traansthyretin in plasma and urine using SELDI-TOF-MS immunoassay. Proteome Sci. 2004, 2(1) article 5, pp. 1-6.
Sekijima Y., et al., Pathogensis of and Therapeutic Strategies to Ameliorate the Transthyretin Amyloidoses. Current Pharmaceutical Design, Jan. 1, 2008, pp. 3219-3230, vol. 14, No. 30.
Stein T., et al., Neutralization of transthyretin reverses the neuroprotective effects of secreted amyloid precursor protein (APP) in APP sw mice resulting in Tau phosphorylation and loss of Hippocampal neurons: support for the amyloid hypothesis. The Journal of Neuroscience, Sep. 1, 2004, vol. 24, No. 35, pp. 7707-7717.
Supplementary European Search Report for European Patent Application No. 10829034, Aug. 30, 2013, 9 pages.
The State Intellectual Property Office of The People's Republic of China, Notification of the First Office Action, Chinese Patent Application No. 200980141740.4, Jun. 5, 2012.
Trenchevska, et al., Mass spectrometric immunoassay for quantitative determination of transthyretin and its variants. Proteomics Aug. 9, 2011, 11(18):3633-3641; abstract p. 3633, para 1; p. 3634, para 5-6; p. 3635, para 1-4; p. 3636, para 2-3; p. 3637, para 2; p. 3639, para 3; Table 4; Figs 2-3.
Tuschl T., et al., Small Interfering RNAs: A Revolutionary Tool for the Analysis of Gene Function and Gene Therapy. Molecular Interventions, 2002, pp. 158-167, vol. 2, No. 3.
Tuschl T., et al., Targeted mRNA Degradation by Double-Stranded RNA In Vitro. Genes & Development, 1999, pp. 3191-3197, vol. 13.
Tuschl T., Expanding small RNA interference. Nature Biotechnology, May 2002, pp. 446-448, vol. 20.
Tuschl T., Functional genomics: RNA sets the standard. Nature, Jan. 16, 2003, vol. 421, No. 6920, pp. 220-221.
Tuschl T., Mammalian RNA Interference. RNAi, A Guide to Gene Silencing, Chapter 13, G.J. Hannon (ed.), 2003, pp. 265-295.
Tuschl T., RNA Interference and Small Interfering RNAs. Chembiochem, 2001 pp. 39-245, vol. 2.
Ueda M, et al., A transgenic rat with the human ATTR V30M: A novel tool for analysis of ATTY metabolisms. Biochemical and Biophysical Research Communications, 2006, pp. 299-304, vol. 352.
Ueda M, et al., SELDI-TOF mass spectrometry evaluation of variant transthyretins for diagnosis and pathogenesis of familial amyloidotic polyneuropathy. Clin. Chem 2009; 55(6):1223-1227; abstract, Table 1.
Vickers T., et al., Efficient Reduction of Target RNAs by Small Interfering RNA and RNase H-dependent Antisense Agents. The Journal of Biological Chemistry, Feb. 28, 2003, pp. 7108-7118, vol. 278, No. 9.
Weil et al., Targeting the Kinesin Eg5 to Monitor siRNA Transfection in Mammalian Cells. Biotechniques, 2002, vol. 33, No. 6, pp. 1244-1248.
Zimmerman TS., et al., RNAi-mediated gene silencing in non-human primates. Nature, May 4, 2006, vol. 441, pp. 111-114.
Smith et al., "Knockdown of cortical transthyretin expression around implanted neural prosthetic devices using intraventricular siRNA injection in the brain", Journal of Neuroscience Methods, vol. 203(2), pp. 398-406 (2011).
Wy Sah Dinah et al., "802: ALN-TTR, An RNAI Therapeutic for the Treatment of Transthyretin Amyloidosis", Nucleic Acid Therapeutics, vol. 21(5), pp. A55-A56 (2011).
European Search Report from European Patent Application No. 12850255.6, dated May 11, 2015.

* cited by examiner

FIG. 3

Human TTR mRNA Sequence (SEQ ID NO: 1), Gen Bank Accession No.: M10605, GI: 189583

```
  1 cagaagtcca ctcattcttg gcaggatggc ttctcatcgt ctgcctcctc tctgccttgc
 61 tggactggta tttgtgtctg aggctggccc tacggcacc ggtgaatcca agtgtcctct
121 gatggtcaaa gttctagatg gttctccgagg ctgtcctgcc cagtcctgcc cgtgcatgt
181 gttcagaaag gctgctgatg acacctggga caccctgga gccattgcc tctgggaaaa ccagtgagtc
241 tggagagctg catgggctca caactgagga caactgagga ggaatttgta gaagggatat acaaagtgga
301 aatagacacc aaatcttact ggaaggcact tggcatctcc ccattccatg agcatgcaga
361 ggtggtattc acagccaacg actccgcc ccgcgtcgt accattgccg ccctgctgag
421 ccctactcc tattccacca cggctgtcgt caccaatccc tttcatgtaa ggacttctcc
481 tccagtggac ctgaaggacg aggatggga tttcatgtaa ccaagagtat tccatttta
541 ctaaagcagt gttttcacct catatgctat gttagaaagtc caggcagaga caataaaaca
601 ttcctgtgaa aggc
```

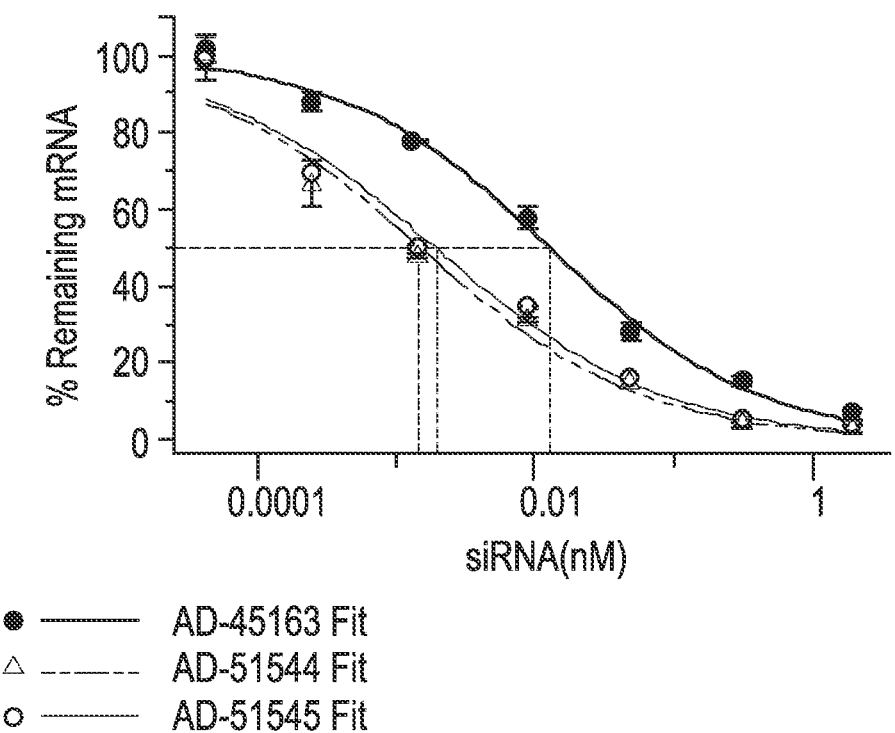

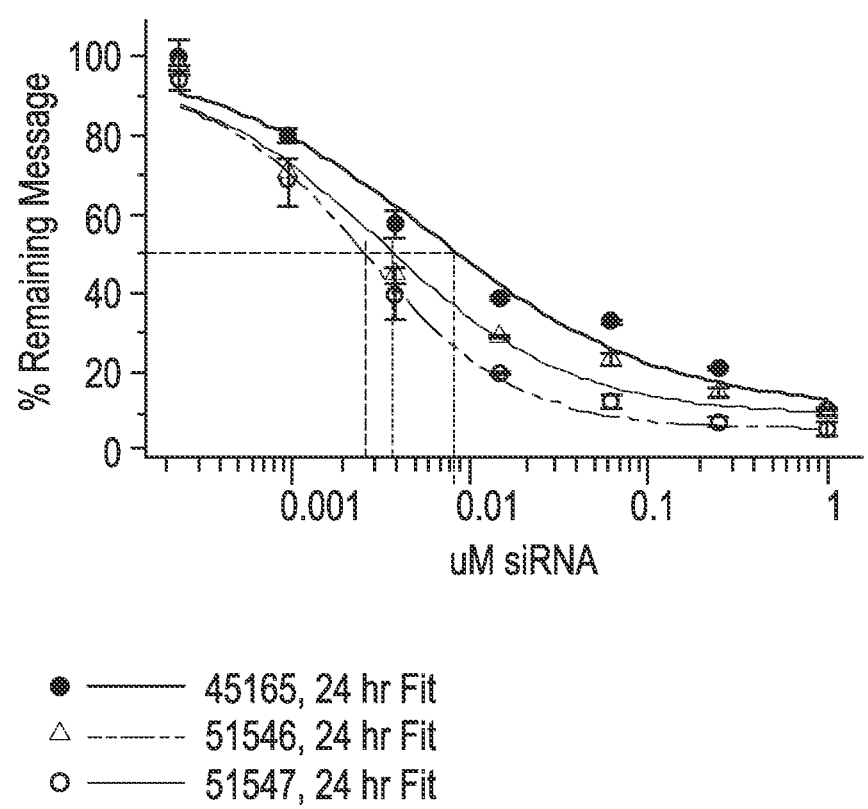

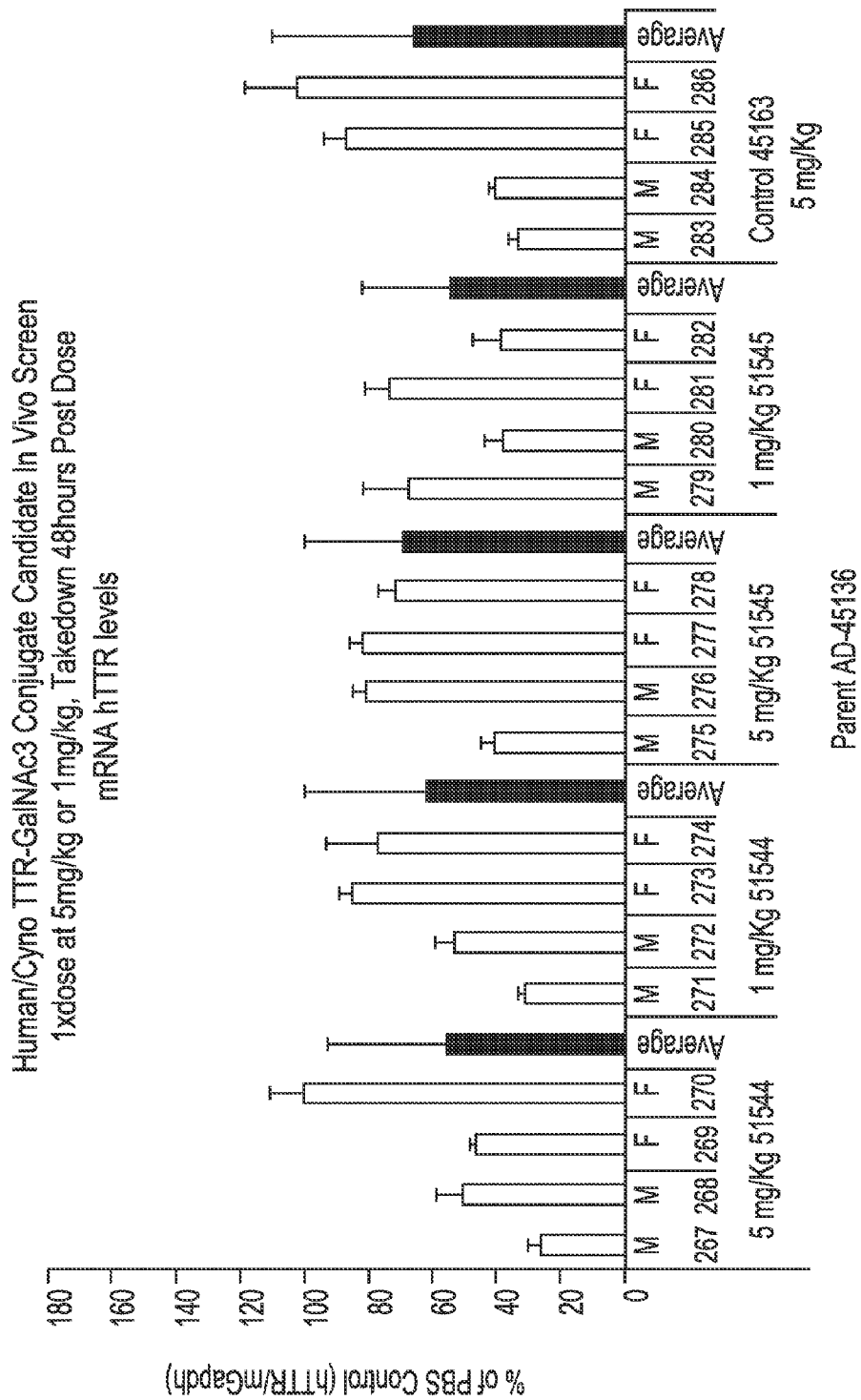

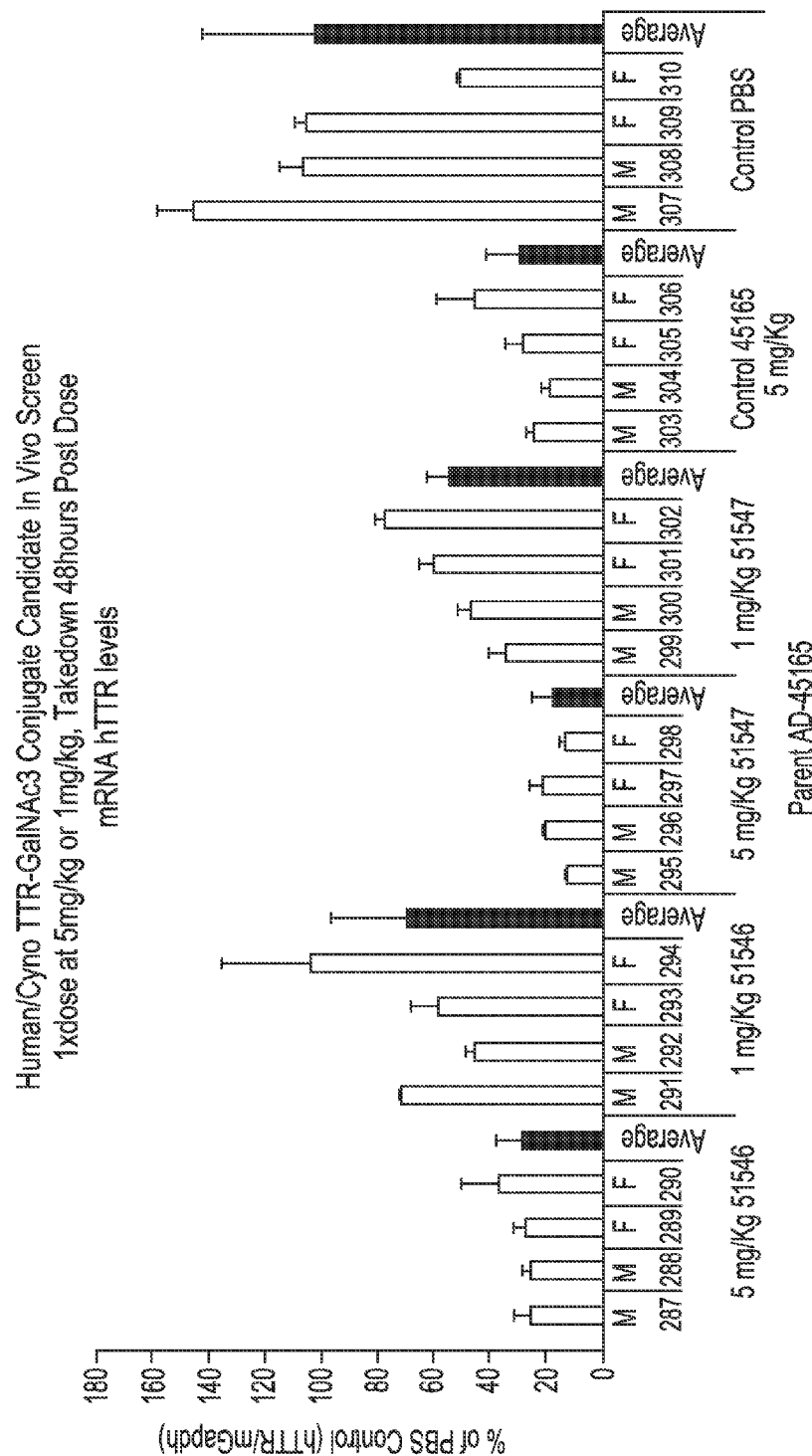

Relative TTR Protein – Single s.c. dose, 48h

Relative TTR Protein - Single s.c. dose, 48h

FIG. 14
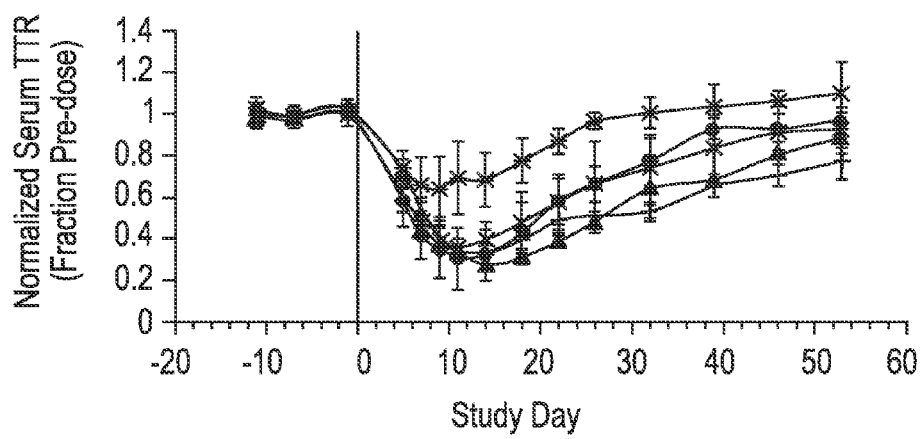
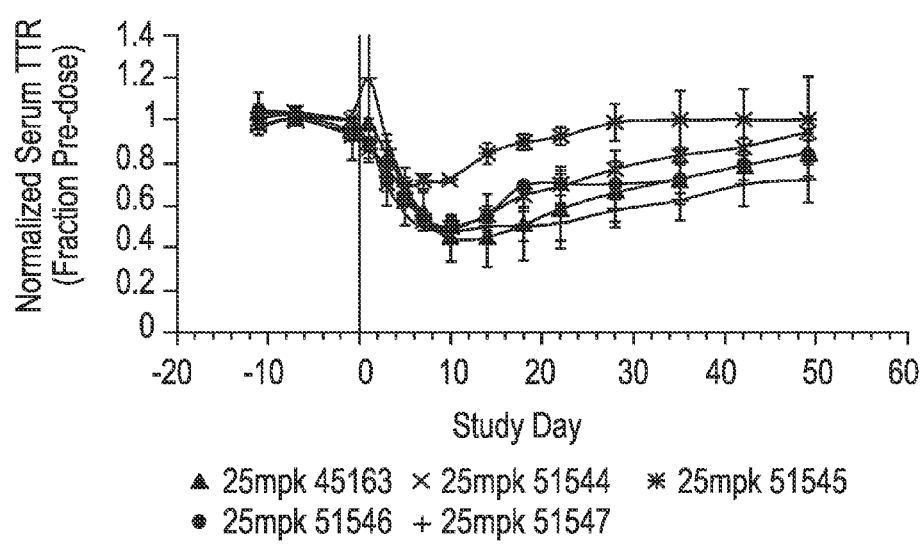

RNAI AGENTS, COMPOSITIONS AND METHODS OF USE THEREOF FOR TREATING TRANSTHYRETIN (TTR) ASSOCIATED DISEASES

RELATED APPLICATIONS

This application is a 35 U.S.C. §371 national stage filing of International Application No. PCT/US2012/065691, filed Nov. 16, 2012, which claims priority to U.S. Provisional Application No. 61/561,710, filed on Nov. 18, 2011, U.S. Provisional Application No. 61/615,618, filed on Mar. 26, 2012, and U.S. Provisional Application No. 61/680,098, filed on Aug. 6, 2012, the entire contents of each of which are hereby incorporated herein by reference.

SEQUENCE LISTING

The instant application contains a Sequence Listing which has been submitted in ASCII format via EFS-Web and is hereby incorporated by reference in its entirety. Said ASCII copy, created on Nov. 13, 2012, is named 121301WO.txt and is 541,508 bytes in size.

BACKGROUND OF THE INVENTION

Transthyretin (TTR) (also known as prealbumin) is found in serum and cerebrospinal fluid (CSF). TTR transports retinol-binding protein (RBP) and thyroxine (T4) and also acts as a carrier of retinol (vitamin A) through its association with RBP in the blood and the CSF. Transthyretin is named for its transport of thyroxine and retinol. TTR also functions as a protease and can cleave proteins including apoA-I (the major HDL apolipoprotein), amyloid β-peptide, and neuropeptide Y. See Liz, M. A. et al. (2010) *IUBMB Life,* 62(6):429-435.

TTR is a tetramer of four identical 127-amino acid subunits (monomers) that are rich in beta sheet structure. Each monomer has two 4-stranded beta sheets and the shape of a prolate ellipsoid. Antiparallel beta-sheet interactions link monomers into dimers. A short loop from each monomer forms the main dimer-dimer interaction. These two pairs of loops separate the opposed, convex beta-sheets of the dimers to form an internal channel.

The liver is the major site of TTR expression. Other significant sites of expression include the choroid plexus, retina (particularly the retinal pigment epithelium) and pancreas.

Transthyretin is one of at least 27 distinct types of proteins that is a precursor protein in the formation of amyloid fibrils. See Guan, J. et al. (Nov. 4, 2011) Current perspectives on cardiac amyloidosis, *Am J Physiol Heart Circ Physiol*, doi: 10.1152/ajpheart.00815.2011. Extracellular deposition of amyloid fibrils in organs and tissues is the hallmark of amyloidosis. Amyloid fibrils are composed of misfolded protein aggregates, which may result from either excess production of or specific mutations in precursor proteins. The amyloidogenic potential of TTR may be related to its extensive beta sheet structure; X-ray crystallographic studies indicate that certain amyloidogenic mutations destabilize the tetrameric structure of the protein. See, e.g., Saraiva M. J. M. (2002) *Expert Reviews in Molecular Medicine,* 4(12):1-11.

Amyloidosis is a general term for the group of amyloid diseases that are characterized by amyloid deposits. Amyloid diseases are classified based on their precursor protein; for example, the name starts with "A" for amyloid and is followed by an abbreviation of the precursor protein, e.g., ATTR for amloidogenic transthyretin. Ibid.

There are numerous TTR-associated diseases, most of which are amyloid diseases. Normal-sequence TTR is associated with cardiac amyloidosis in people who are elderly and is termed senile systemic amyloidosis (SSA) (also called senile cardiac amyloidosis (SCA) or cardiac amyloidosis). SSA often is accompanied by microscopic deposits in many other organs. TTR amyloidosis manifests in various forms. When the peripheral nervous system is affected more prominently, the disease is termed familial amyloidotic polyneuropathy (FAP). When the heart is primarily involved but the nervous system is not, the disease is called familial amyloidotic cardiomyopathy (FAC). A third major type of TTR amyloidosis is leptomeningeal amyloidosis, also known as leptomeningeal or meningocerebrovascular amyloidosis, central nervous system (CNS) amyloidosis, or amyloidosis VII form. Mutations in TTR may also cause amyloidotic vitreous opacities, carpal tunnel syndrome, and euthyroid hyperthyroxinemia, which is a non-amyloidotic disease thought to be secondary to an increased association of thyroxine with TTR due to a mutant TTR molecule with increased affinity for thyroxine. See, e.g., Moses et al. (1982) *J. Clin. Invest.,* 86, 2025-2033.

Abnormal amyloidogenic proteins may be either inherited or acquired through somatic mutations. Guan, J. et al. (Nov. 4, 2011) Current perspectives on cardiac amyloidosis, *Am J Physiol Heart Circ Physiol*, doi:10.1152/ajpheart.00815.2011. Transthyretin associated ATTR is the most frequent form of hereditary systemic amyloidosis. Lobato, L. (2003) *J. Nephrol.,* 16:438-442. TTR mutations accelerate the process of TTR amyloid formation and are the most important risk factor for the development of ATTR. More than 85 amyloidogenic TTR variants are known to cause systemic familial amyloidosis. TTR mutations usually give rise to systemic amyloid deposition, with particular involvement of the peripheral nervous system, although some mutations are associated with cardiomyopathy or vitreous opacities. Ibid.

The V30M mutation is the most prevalent TTR mutation. See, e.g., Lobato, L. (2003) *J Nephrol,* 16:438-442. The V122I mutation is carried by 3.9% of the African American population and is the most common cause of FAC. Jacobson, D. R. et al. (1997) *N. Engl. J. Med.* 336 (7): 466-73. It is estimated that SSA affects more than 25% of the population over age 80. Westermark, P. et al. (1990) *Proc. Natl. Acad. Sci. U.S.A.* 87 (7): 2843-5.

Accordingly, there is a need in the art for effective treatments for TTR-associated diseases.

SUMMARY OF THE INVENTION

The present invention provides RNAi agents, e.g., double stranded RNAi agents, targeting the Transthyretin (TTR) gene. The present invention also provides methods of inhibiting expression of TTR and methods of treating or preventing a TTR-associated disease in a subject using the RNAi agents, e.g. double stranded RNAi agents, of the invention. The present invention is based, at least in part, on the discovery that RNAi agents that comprise particular chemical modifications show a superior ability to inhibit expression of TTR. Agents including a certain pattern of chemical modifications (e.g., an alternating pattern) and a ligand are shown herein to be effective in silencing the activity of the TTR gene. Furthermore, agents including one or more motifs of three identical modifications on three consecutive nucleotides, including one such motif at or near the cleavage site of the agents, show surprisingly enhanced TTR gene silencing activity. When a single such chemical motif is present in the agent, it is preferred to be at or near the cleavage region for enhancing of the gene silencing activity. Cleavage region is the region surrounding the cleavage site, i.e., the site on the target mRNA at which cleavage occurs.

Accordingly, in one aspect, the present invention features RNAi agents, e.g., double stranded RNAi agents, for inhibiting expression of a transthyretin (TTR). The double stranded RNAi agent includes a sense strand complementary to an antisense strand. The antisense strand includes a region complementary to a part of an mRNA encoding transthyretin. Each strand has 14 to 30 nucleotides, and the double stranded RNAi agent is represented by formula (III):

sense: 5' $n_p$-$N_a$-(XXX)$_i$-$N_b$-YYY-$N_b$-(ZZZ)$_j$-$N_a$-$n_q$ 3' antisense: 3' $n_p'$-$N_a'$-(X'X'X')$_k$-$N_b'$-Y'Y'Y'-$N_b'$-(Z'Z'Z')$_l$-$N_a'$-$n_q'$ 5' (III).

In Formula III, i, j, k, and l are each independently 0 or 1; p, p', q, and q' are each independently 0-6; each $N_a$ and $N_a'$ independently represents an oligonucleotide sequence including 0-25 nucleotides which are either modified or unmodified or combinations thereof, each sequence including at least two differently modified nucleotides; each $N_b$ and $N_b'$ independently represents an oligonucleotide sequence including 0-10 nucleotides which are either modified or unmodified or combinations thereof; each $n_p$, $n_p'$, $n_q$, and $n_q'$ independently represents an overhang nucleotide; XXX, YYY, ZZZ, X'X'X', Y'Y'Y', and Z'Z'Z' each independently represents one motif of three identical modifications on three consecutive nucleotides; modifications on $N_b$ differ from the modification on Y and modifications on $N_b'$ differ from the modification on Y'. In some embodiments, the sense strand is conjugated to at least one ligand, e.g., at least one ligand, e.g., at least one ligand attached to the 3' end of the sense strand. In other embodiments, the ligand may be conjugated to the antisense strand.

In some embodiments, i is 1; j is 1; or both i and j are 1.
In some embodiments, k is 1; l is 1; or both k and l are 1.
In some embodiments, i is 0; j is 1.
In some embodiments, i is 1, j is 0.
In some embodiments, k is 0; l is 1.
In some embodiments, k is 1; l is 0.
In some embodiments, XXX is complementary to X'X'X', YYY is complementary to Y'Y'Y', and ZZZ is complementary to Z'Z'Z'.

In some embodiments, the YYY motif occurs at or near the cleavage site of the sense strand.

In some embodiments, the Y'Y'Y' motif occurs at the 11, 12 and 13 positions of the antisense strand from the 5'-end.

In some embodiments, the Y' is 2'-O-methyl.
In some embodiments, the Y' is 2'-fluoro.
In some embodiments, formula (III) is represented as formula (IIIa):

sense: 5' $n_p$-$N_a$-YYY—$N_b$-ZZZ-$N_a$-$n_q$ 3' antisense: 3' $n_p'$-$N_a'$-Y'Y'Y'-$N_b'$-Z'Z'Z'-$N_a'$$n_q'$ 5' (IIIa).

In formula IIIa, each $N_b$ and $N_b'$ independently represents an oligonucleotide sequence including 1-5 modified nucleotides.

In some embodiments, formula (III) is represented as formula (IIIb):

sense: 5' $n_p$-$N_a$-XXX-$N_b$-YYY-$N_a$-$n_q$ 3' antisense: 3' $n_p'$-$N_a'$-X'X'X'-$N_b'$-Y'Y'Y'-$N_a'$-$n_q'$ 5' (IIIb).

In formula IIIb each $N_b$ and $N_b'$ independently represents an oligonucleotide sequence including 1-5 modified nucleotides.

In some embodiments, formula (III) is represented as formula (IIIc):

sense: 5' $n_p$-$N_a$-XXX-$N_b$-YYY-$N_b$-ZZZ-$N_a$-$n_q$ 3' antisense: 3' $n_p'$-$N_a'$-X'X'X'-$N_b'$-Y'Y'Y'-$N_b'$-Z'Z'Z'-$N_a'$-$n_q'$ 5' (IIIc).

In formula IIIc, each $N_b$ and —$N_b'$ independently represents an oligonucleotide sequence including 1-5 modified nucleotides and each $N_a$ and $N_a'$ independently represents an oligonucleotide sequence including 2-10 modified nucleotides.

In many embodiments, the duplex region is 15-30 nucleotide pairs in length. In some embodiments, the duplex region is 17-23 nucleotide pairs in length, 17-25 nucleotide pairs in length, 23-27 nucleotide pairs in length, 19-21 nucleotide pairs in length, or 21-23 nucleotide pairs in length.

In certain embodiments, each strand has 15-30 nucleotides.

In some embodiments, the modifications on the nucleotides are selected from the group consisting of LNA, HNA, CeNA, 2'-methoxyethyl, 2'-O-alkyl, 2'-O-allyl, 2'-C-allyl, 2'-fluoro, 2'-deoxy, 2'-hydroxyl, and combinations thereof. In some preferred embodiments, the modifications on the nucleotides are 2'-O-methyl or 2'-fluoro.

In some embodiments, the ligand is one or more N-acetylgalactosamine (GalNAc) derivatives attached through a bivalent or trivalent branched linker. In particular embodiments, the ligand is

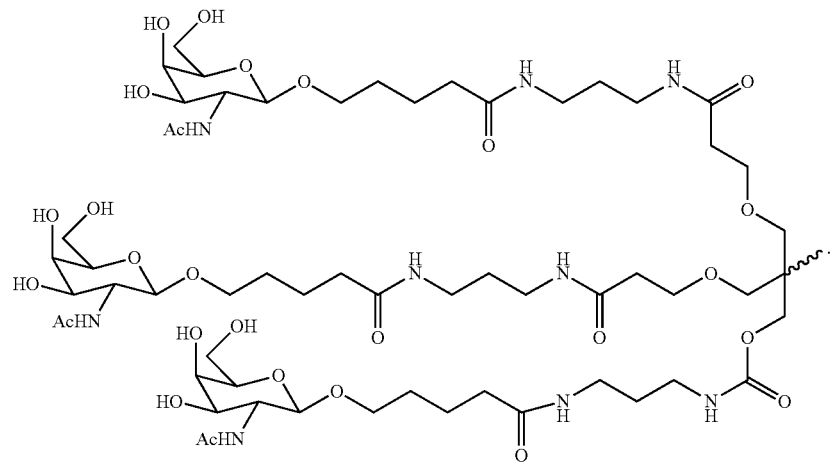 [SMILES: CC(=O)NC1C(OCCCCC(=O)NCCCNC(=O)CCOCC(C)(COCCC(=O)NCCCNC(=O)CCCCOC2OC(CO)C(O)C(O)C2NC(C)=O)COC(=O)NCCCNC(=O)CCCCOC2OC(CO)C(O)C(O)C2NC(C)=O)OC(CO)C(O)C1O]

In some embodiments, the ligand is attached to the 3' end of the sense strand.

In some embodiments, the RNAi agent is conjugated to the ligand as shown in the following schematic

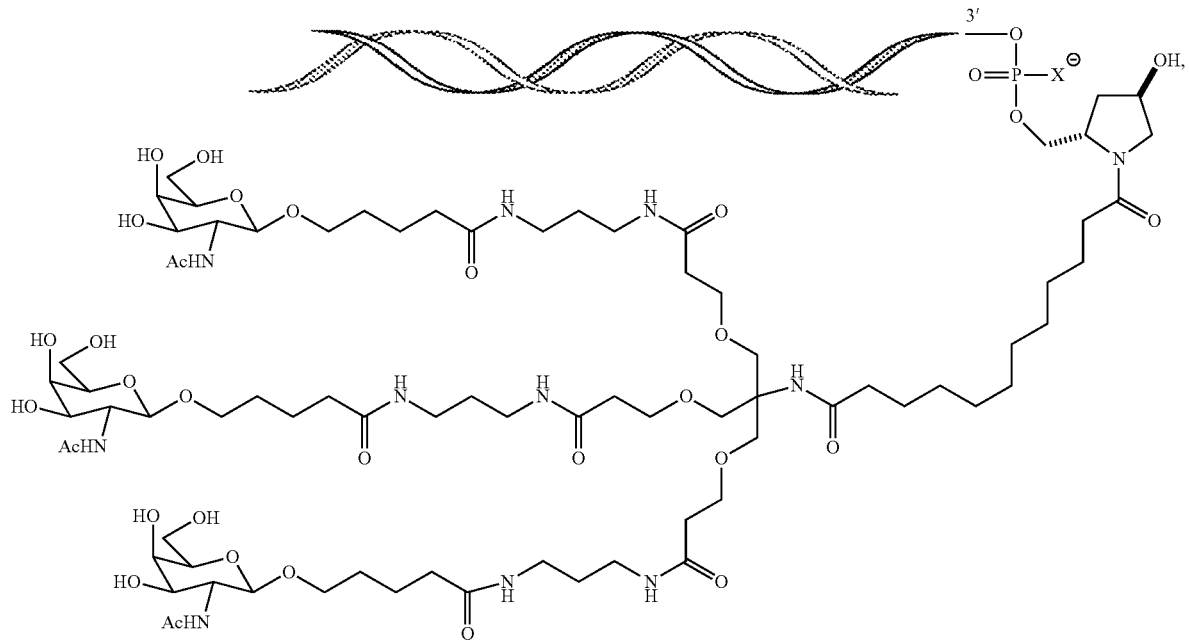

wherein X is O or S.

In some embodiments, the RNAi agent is conjugated to the ligand as shown in the following schematic

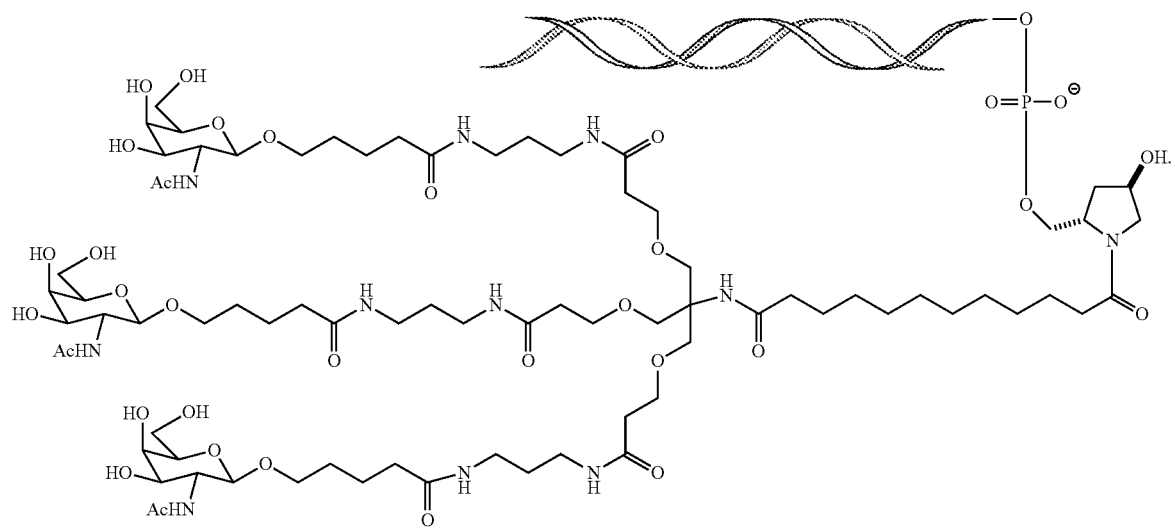 [SMILES: COP(=O)([O-])OC[C@@H]1C[C@@H](O)CN1C(=O)CCCCCCCCCCC(=O)NC(COCCC(=O)NCCCNC(=O)CCCCOC1OC(CO)C(O)C(O)C1NC(C)=O)(COCCC(=O)NCCCNC(=O)CCCCOC1OC(CO)C(O)C(O)C1NC(C)=O)COCCC(=O)NCCCNC(=O)CCCCOC1OC(CO)C(O)C(O)C1NC(C)=O]

In some embodiments, the RNAi agent further includes at least one phosphorothioate or methylphosphonate internucleotide linkage. In some embodiments, the phosphorothioate or methylphosphonate internucleotide linkage is at the 3'-terminal of one strand. In some embodiments, the strand is the antisense strand. In other embodiments, the strand is the sense strand.

In certain embodiments, the base pair at the 1 position of the 5'-end of the duplex is an AU base pair.

In some embodiments, the Y nucleotides contain a 2'-fluoro modification.

In some embodiments, the Y' nucleotides contain a 2'-O-methyl modification.

In some embodiments, p'>0. In some such embodiments, each n is complementary to the target mRNA. In other such embodiments, each n is non-complementary to the target mRNA. In some embodiments, p, p', q and q' are 1-6. In some preferred embodiments, p'=1 or 2. In some preferred embodiments, p'=2. In some such embodiments, q'=0, p=0, q=0, and p' overhang nucleotides are complementary to the target mRNA. In other such embodiments, q'=0, p=0, q=0, and p' overhang nucleotides are non-complementary to the target mRNA.

In some embodiments, the sense strand has a total of 21 nucleotides and the antisense strand has a total of 23 nucleotides.

In certain embodiments, linkages between $n_p'$ include phosphorothioate linkages. In some such embodiments, the linkages between $n_p'$ are phosphorothioate linkages.

In some embodiments, the RNAi agent is selected from the group of agents listed in Table 1.

In preferred embodiments, the RNAi agent is selected from the group consisting of AD-51544, AD-51545, AD-51546, and AD-51547.

In an even more preferred embodiment, the RNAi agent is AD-51547 having the following structure:

```
sense:
                                      (SEQ ID NO: 2)
5'- UfgGfgAfuUfuCfAfUfgUfaacCfaAfgAfL96-3' antisense:
                                      (SEQ ID NO: 3)
5'- uCfuUfgGfUfUfaCfaugAfaAfuCfcCfasUfsc-3'
``` wherein lowercase nucleotides (a, u, g, c) indicate 2'-O-methyl nucleotides; Nf (e.g., Af) indicates a 2'-fluoro nucleotide; s indicates a phosphothiorate linkage; L96 indicates a GalNAc$_3$ ligand.

In another aspect, the present invention features a cell containing the RNAi agent for inhibiting expression of TTR. In a further aspect, the present invention features a pharmaceutical composition comprising an RNAi agent for inhibiting expression of TTR. In some embodiments, the pharmaceutical composition is a solution comprising the RNAi agent. In some embodiments, the solution comprising the RNAi agent is an unbuffered solution, e.g., saline solution or water. In other embodiments, the solution is a buffered solution, e.g., a solution of phosphate buffered saline (PBS). In other embodiments, the pharmaceutical composition is a liposome or a lipid formulation. In some embodiments, the lipid formulation comprises a XTC or MC3.

In yet another aspect, the present invention features methods of inhibiting expression of transthyretin (TTR) in a cell. The methods include contacting a cell with an RNAi agent, e.g., a double stranded RNAi agent, in an amount effective to inhibit expression of TTR in the cell, thereby inhibiting expression of TTR in the cell.

In some embodiments, the expression of TTR is inhibited by at least about 10%, at least about 20%, at least about 30%, at least about 40%, at least about 50%, at least about 60%, at least about 70%, at least about 80%, or at least about 90%.

In other embodiments, the cell is contacted in vitro with the RNAi agent. In other embodiments, the cell is present within a subject. In preferred embodiments, the subject is a human.

In further embodiments, the subject is a subject suffering from a TTR-associated disease and the effective amount is a therapeutically effective amount. In other embodiments, the subject is a subject at risk for developing a TTR-associated disease and the effective amount is a prophylactically effective amount. In some embodiments, a subject at risk for developing a TTR-associated disease is a subject who carries a TTR gene mutation that is associated with the development of a TTR-associated disease.

In certain embodiments, the TTR-associated disease is selected from the group consisting of senile systemic amyloidosis (SSA), systemic familial amyloidosis, familial amyloidotic polyneuropathy (FAP), familial amyloidotic cardiomyopathy (FAC), leptomeningeal/Central Nervous System (CNS) amyloidosis, and hyperthyroxinemia.

In some embodiments, the subject has a TTR-associated amyloidosis and the method reduces an amyloid TTR deposit in the subject.

In other embodiments, the RNAi agent is administered to the subject by an administration means selected from the group consisting of subcutaneous, intravenous, intramuscular, intrabronchial, intrapleural, intraperitoneal, intraarterial, lymphatic, cerebrospinal, and any combinations thereof. In certain embodiments, the RNAi agent is administered to the subject via subcutaneous or intravenous administration. In preferred embodiments, the RNAi agent is administered to the subject via subcutaneous administration. In some such embodiments, the subcutaneous administration includes administration via a subcutaneous pump or subcutaneous depot.

In certain embodiments, the RNAi agent is administered to the subject such that the RNAi agent is delivered to a specific site within the subject. In some embodiments, the site is selected from the group consisting of liver, choroid plexus, retina, and pancreas. In preferred embodiments, the site is the liver. In some embodiments, the delivery of the RNAi agent is mediated by asialoglycoprotein receptor (ASGP-R) present in hepatocytes.

In some embodiments, the RNAi agent is administered at a dose of between about 0.25 mg/kg to about 50 mg/kg, e.g., between about 0.25 mg/kg to about 0.5 mg/kg, between about 0.25 mg/kg to about 1 mg/kg, between about 0.25 mg/kg to about 5 mg/kg, between about 0.25 mg/kg to about 10 mg/kg, between about 1 mg/kg to about 10 mg/kg, between about 5 mg/kg to about 15 mg/kg, between about 10 mg/kg to about 20 mg/kg, between about 15 mg/kg to about 25 mg/kg, between about 20 mg/kg to about 30 mg/kg, between about 25 mg/kg to about 35 mg/kg, or between about 40 mg/kg to about 50 mg/kg.

In some embodiments, the RNAi agent is administered at a dose of about 0.25 mg/kg, about 0.5 mg/kg, about 1 mg/kg, about 2 mg/kg, about 3 mg/kg, about 4 mg/kg, about 5 mg/kg, about 6 mg/kg, about 7 mg/kg, about 8 mg/kg, about 9 mg/kg, about 10 mg/kg, about 11 mg/kg, about 12 mg/kg, about 13 mg/kg, about 14 mg/kg, about 15 mg/kg, about 16 mg/kg, about 17 mg/kg, about 18 mg/kg, about 19 mg/kg, about 20 mg/kg, about 21 mg/kg, about 22 mg/kg, about 23 mg/kg, about 24 mg/kg, about 25 mg/kg, about 26 mg/kg, about 27 mg/kg, about 28 mg/kg, about 29 mg/kg, 30 mg/kg, about 31 mg/kg, about 32 mg/kg, about 33 mg/kg, about 34 mg/kg, about 35 mg/kg, about 36 mg/kg, about 37 mg/kg, about 38 mg/kg, about 39 mg/kg, about 40 mg/kg, about 41 mg/kg, about 42 mg/kg, about 43 mg/kg, about 44 mg/kg, about 45 mg/kg, about 46 mg/kg, about 47 mg/kg, about 48 mg/kg, about 49 mg/kg or about 50 mg/kg.

In some embodiments, the RNAi agent is administered in two or more doses. In particular embodiments, the RNAi agent is administered at intervals selected from the group consisting of once every about 2 hours, once every about 3 hours, once every about 4 hours, once every about 6 hours, once every about 8 hours, once every about 12 hours, once every about 24 hours, once every about 48 hours, once every about 72 hours, once every about 96 hours, once every about 120 hours, once every about 144 hours, once every about 168 hours, once every about 240 hours, once every about 336 hours, once every about 504 hours, once every about 672 hours and once every about 720 hours.

In other embodiments, the method further includes assessing the level of TTR mRNA expression or TTR protein expression in a sample derived from the subject.

In preferred embodiments, administering the RNAi agent does not result in an inflammatory response in the subject as assessed based on the level of a cytokine or chemokine selected from the group consisting of G-CSF, IFN-γ, IL-10, IL-12 (p70), IL1β, IL-1ra, IL-6, IL-8, IP-10, MCP-1, MIP-1α, MIP-1β, TNFα, and any combinations thereof, in a sample from the subject.

In some embodiments, the RNAi agent is administered using a pharmaceutical composition In preferred embodiments, the RNAi agent is administered in a solution. In some such embodiments, the siRNA is administered in an unbuffered solution. In one embodiment, the siRNA is administered in water. In other embodiments, the siRNA is administered with a buffer solution, such as an acetate buffer, a citrate buffer, a prolamine buffer, a carbonate buffer, or a phosphate buffer or any combination thereof. In some embodiments, the buffer solution is phosphate buffered saline (PBS).

In another embodiment, the pharmaceutical composition is a liposome or a lipid formulation comprising SNALP or XTC. In one embodiment, the lipid formulation comprises an MC3.

In another aspect, the invention provides methods of treating or preventing a TTR-associated disease in a subject. The methods include administering to the subject a therapeutically effective amount or prophylactically effective amount of an RNAi agent, e.g., a double stranded RNAi agent, thereby treating or preventing the TTR-associated disease in the subject.

In some embodiments, TTR expression in a sample derived from the subject is inhibited by at least about 10%, at least about 20%, at least about 30%, at least about 40%, at least about 50%, at least about 60% or at least about 70% at least about 80%, or at least about 90%.

In some embodiments, the subject is a human.

In some embodiments, the subject is a subject suffering from a TTR-associated disease. In other embodiments, the subject is a subject at risk for developing a TTR-associated disease.

In some embodiments, the subject is a subject who carries s a TTR gene mutation that is associated with the development of a TTR-associated disease.

In certain embodiments, the TTR-associated disease is selected from the group consisting of senile systemic amyloidosis (SSA), systemic familial amyloidosis, familial amyloidotic polyneuropathy (FAP), familial amyloidotic cardiomyopathy (FAC), leptomeningeal/Central Nervous System (CNS) amyloidosis, and hyperthyroxinemia.

In some embodiments, the subject has a TTR-associated amyloidosis and the method reduces an amyloid TTR deposit in the subject.

In some embodiments, the RNAi agent is administered to the subject by an administration means selected from the group consisting of subcutaneous, intravenous, intramuscular, intrabronchial, intrapleural, intraperitoneal, intraarterial, lymphatic, cerebrospinal, and any combinations thereof. In certain embodiments, the RNAi agent is administered to the subject via subcutaneous or intravenous administration. In preferred embodiments, the RNAi agent is administered to the subject via subcutaneous administration. In some such embodiments, the subcutaneous administration includes administration via a subcutaneous pump or subcutaneous depot.

In certain embodiments, the RNAi agent is administered to the subject such that the RNAi agent is delivered to a specific site within the subject. In some such embodiments, the site is selected from the group consisting of liver, choroid plexus, retina, and pancreas. In preferred embodiments, the site is the liver. In some embodiments, the delivery of the RNAi agent is mediated by asialoglycoprotein receptor (ASGP-R) present in hepatocytes.

In some embodiments, the RNAi agent is administered at a dose of between about 0.25 mg/kg to about 50 mg/kg, e.g., between about 0.25 mg/kg to about 0.5 mg/kg, between about 0.25 mg/kg to about 1 mg/kg, between about 0.25 mg/kg to about 5 mg/kg, between about 0.25 mg/kg to about 10 mg/kg, between about 1 mg/kg to about 10 mg/kg, between about 5 mg/kg to about 15 mg/kg, between about 10 mg/kg to about 20 mg/kg, between about 15 mg/kg to about 25 mg/kg, between about 20 mg/kg to about 30 mg/kg, between about 25 mg/kg to about 35 mg/kg, or between about 40 mg/kg to about 50 mg/kg.

In some embodiments, the RNAi agent is administered at a dose of about 0.25 mg/kg, about 0.5 mg/kg, about 1 mg/kg, about 2 mg/kg, about 3 mg/kg, about 4 mg/kg, about 5 mg/kg, about 6 mg/kg, about 7 mg/kg, about 8 mg/kg, about 9 mg/kg, about 10 mg/kg, about 11 mg/kg, about 12 mg/kg, about 13 mg/kg, about 14 mg/kg, about 15 mg/kg, about 16 mg/kg, about 17 mg/kg, about 18 mg/kg, about 19 mg/kg, about 20 mg/kg, about 21 mg/kg, about 22 mg/kg, about 23 mg/kg, about 24 mg/kg, about 25 mg/kg, about 26 mg/kg, about 27 mg/kg, about 28 mg/kg, about 29 mg/kg, 30 mg/kg, about 31 mg/kg, about 32 mg/kg, about 33 mg/kg, about 34 mg/kg, about 35 mg/kg, about 36 mg/kg, about 37 mg/kg, about 38 mg/kg, about 39 mg/kg, about 40 mg/kg, about 41 mg/kg, about 42 mg/kg, about 43 mg/kg, about 44 mg/kg, about 45 mg/kg, about 46 mg/kg, about 47 mg/kg, about 48 mg/kg, about 49 mg/kg or about 50 mg/kg.

In some embodiments, the RNAi agent is administered in two or more doses. In particular embodiments, the RNAi agent is administered at intervals selected from the group consisting of once every about 2 hours, once every about 3 hours, once every about 4 hours, once every about 6 hours, once every about 8 hours, once every about 12 hours, once every about 24 hours, once every about 48 hours, once every about 72 hours, once every about 96 hours, once every about 120 hours, once every about 144 hours, once every about 168 hours, once every about 240 hours, once every about 336 hours, once every about 504 hours, once every about 672 hours and once every about 720 hours.

In other embodiments, the method further includes assessing the level of TTR mRNA expression or TTR protein expression in a sample derived from the subject.

In preferred embodiments, administering the RNAi agent does not result in an inflammatory response in the subject as assessed based on the level of a cytokine or chemokine selected from the group consisting of G-CSF, IFN-γ, IL-10, IL-12 (p70), IL1β, IL-1ra, IL-6, IL-8, IP-10, MCP-1, MIP-1α, MIP-1β, TNFα, and any combinations thereof, in a sample from the subject.

In some embodiments, the RNAi agent is administered using a pharmaceutical composition, e.g., a liposome.

In some embodiments, the RNAi agent is administered in a solution. In some such embodiments, the siRNA is administered in an unbuffered solution. In one embodiment, the siRNA is administered in saline or water. In other embodiments, the siRNA is administered with a buffer solution, such as an acetate buffer, a citrate buffer, a prolamine buffer, a carbonate buffer, or a phosphate buffer or any combination thereof. In some embodiments, the buffer solution is phosphate buffered saline (PBS).

In another aspect, the present invention provides a method of inhibiting expression of transthyretin (TTR) in a cell, including contacting a cell with an RNAi agent, e.g., a double stranded RNAi agent, in an amount effective to inhibit expression of TTR in the cell. In one aspect, the double stranded RNAi agent is selected from the group of agents listed in Table 1, thereby inhibiting expression of transthyretin (TTR) in the cell.

In another aspect, the present invention provides a method of inhibiting expression of transthyretin (TTR) in a cell, including contacting a cell with an RNAi agent, e.g., a double stranded RNAi agent, in an amount effective to inhibit expression of TTR in the cell. In one aspect, the double stranded RNAi agent is selected from the group consisting of AD-51544, AD-51545, AD-51546, and AD-51547, thereby inhibiting expression of transthyretin (TTR) in the cell.

In a further aspect, the present invention provides a method of treating or preventing a TTR-associated disease in a subject, including administering to the subject a therapeutically effective amount or a prophylactically effective amount of an RNAi agent, e.g., a double stranded RNAi agent. In one aspect, the double stranded RNAi agent is selected from the group of agents listed in Table 1, thereby treating or preventing a TTR-associated disease in the subject.

In yet another aspect, the present invention provides a method of treating or preventing a TTR-associated disease in a subject, including administering to the subject a therapeutically effective amount or a prophylactically effective amount of an RNAi agent, e.g., a double stranded RNAi agent. In one aspect, the double stranded RNAi agent is selected from the group consisting of AD-51544, AD-51545, AD-51546, and AD-51547, thereby treating or preventing a TTR-associated disease in the subject.

In further aspects, the invention provides kits for performing the methods of the invention. In one aspect, the invention provides a kit for performing a method of inhibiting expression of transthyretin (TTR) in a cell comprising contacting a cell with an RNAi agent, e.g., a double stranded RNAi agent, in an amount effective to inhibit expression of said TTR in said cell, thereby inhibiting the expression of TTR in the cell. The kit comprises an RNAi agent and instructions for use and, optionally, means for administering the RNAi agent to the subject.

The present invention is further illustrated by the following detailed description and drawings.

BRIEF DESCRIPTION OF THE DRAWINGS

FIG. 3 depicts the human TTR mRNA sequence.

FIG. 4 is a graph depicting improved silencing activity of RNAi agents modified relative to the parent AD-45163.

FIG. 9 is a graph depicting improved free uptake silencing following 24 hour incubation with RNAi agents modified relative to the parent AD-45165.

FIG. 10 is a graph depicting silencing of TTR mRNA in transgenic mice that express hTTR V30M following administration of a single subcutaneous dose of RNAi agents AD-51544, AD-51545, AD-45163, AD-51546, AD-51547, or AD-45165.

FIG. 14 is a graph depicting suppression of TTR protein in non-human primates following subcutaneous administration of five 5 mg/kg doses (top panel) or a single 25 mg/kg dose (bottom panel) of AD-45163, AD-51544, AD-51545, AD-51546, or AD-51547.

DETAILED DESCRIPTION OF THE INVENTION

Figure 1:
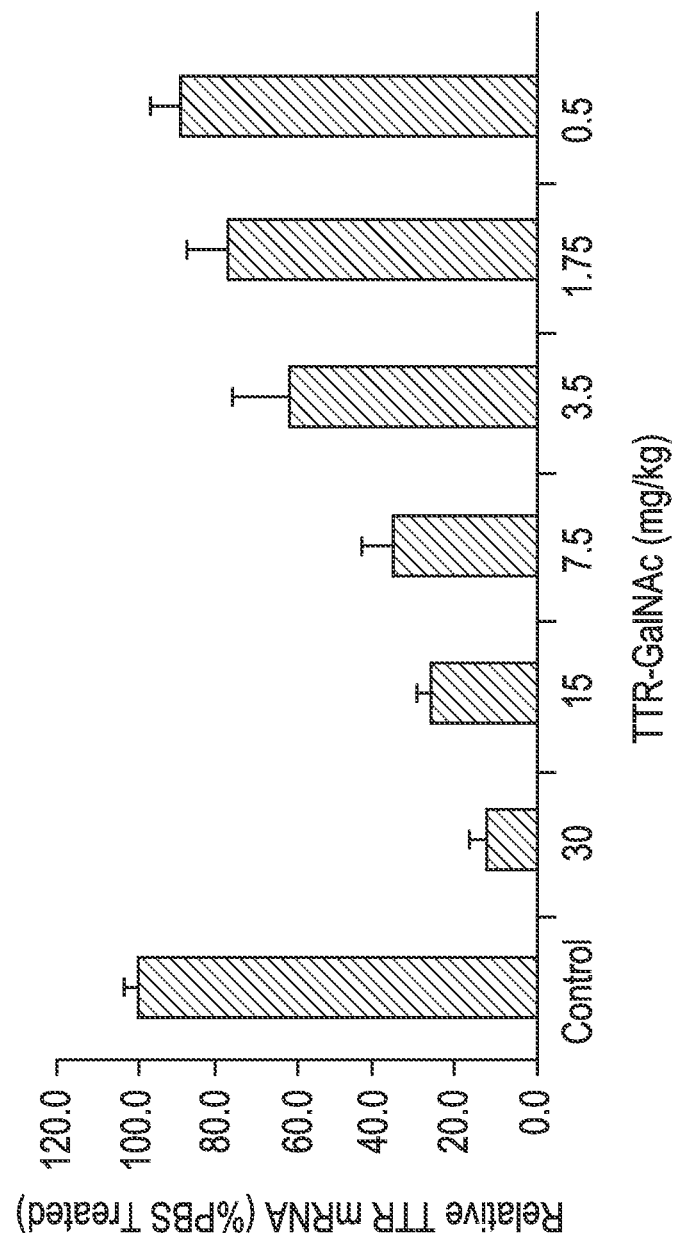
FIG. 1 is a graph depicting that administering to mice a single subcutaneous dose of a GalNAc-conjugated RNAi agent targeting TTR resulted in dose-dependent suppression of TTR mRNA.

The present invention provides RNAi agents, e.g., double stranded RNAi agents, and compositions targeting the Transthyretin (TTR) gene. The present invention also provides methods of inhibiting expression of TTR and methods of treating or preventing a TTR-associated disease in a subject using the RNAi agents, e.g., double stranded RNAi agents, of the invention. The present invention is based, at least in part, on the discovery that RNAi agents that comprise particular chemical modifications show a superior ability to inhibit expression of TTR. Agents including a certain pattern of chemical modifications (e.g., an alternating pattern) and a ligand are shown herein to be effective in silencing the activity of the TTR gene. Furthermore, agents including one or more motifs of three identical modifications on three consecutive nucleotides, including one such motif at or near the cleavage site of the agents, show surprisingly enhanced TTR gene silencing activity. When a single such chemical motif is present in the agent, it is preferred to be at or near the cleavage region for enhancing of the gene silencing activity. Cleavage region is the region surrounding the cleavage site, i.e., the site on the target mRNA at which cleavage occurs.

I. Definitions

As used herein, each of the following terms has the meaning associated with it in this section.

The term "including" is used herein to mean, and is used interchangeably with, the phrase "including but not limited to".

The term "or" is used herein to mean, and is used interchangeably with, the term "and/or," unless context clearly indicates otherwise.

As used herein, a "transthyretin" ("TTR") refers to the well known gene and protein. TTR is also known as prealbumin, HsT2651, PALB, and TBPA. TTR functions as a transporter of retinol-binding protein (RBP), thyroxine (T4) and retinol, and it also acts as a protease. The liver secretes TTR into the blood, and the choroid plexus secretes TTR into the cerebrospinal fluid. TTR is also expressed in the pancreas and the retinal pigment epithelium. The greatest clinical relevance of TTR is that both normal and mutant TTR protein can form amyloid fibrils that aggregate into extracellular deposits, causing amyloidosis. See, e.g., Saraiva M. J. M. (2002) *Expert Reviews in Molecular Medicine*, 4(12):1-11 for a review. The molecular cloning and nucleotide sequence of rat transthyretin, as well as the distribution of mRNA expression, was described by Dickson, P. W. et al. (1985) *J. Biol. Chem.* 260(13)8214-8219. The X-ray crystal structure of human TTR was described in Blake, C. C. et al. (1974) *J Mol Biol* 88, 1-12. The sequence of a human TTR mRNA transcript can be found at National Center for Biotechnology Information (NCBI) RefSeq accession number NM_000371. The sequence of mouse TTR mRNA can be found at RefSeq accession number NM_013697.2, and the sequence of rat TTR mRNA can be found at RefSeq accession number NM_012681.1

As used herein, "target sequence" refers to a contiguous portion of the nucleotide sequence of an mRNA molecule formed during the transcription of a TTR gene, including mRNA that is a product of RNA processing of a primary transcription product.

As used herein, the term "strand comprising a sequence" refers to an oligonucleotide comprising a chain of nucleotides that is described by the sequence referred to using the standard nucleotide nomenclature.

"G," "C," "A" and "U" each generally stand for a nucleotide that contains guanine, cytosine, adenine, and uracil as a base, respectively. "T" and "dT" are used interchangeably herein and refer to a deoxyribonucleotide wherein the nucleobase is thymine, e.g., deoxyribothymine, 2'-deoxythymidine or thymidine. However, it will be understood that the term "ribonucleotide" or "nucleotide" or "deoxyribonucleotide" can also refer to a modified nucleotide, as further detailed below, or a surrogate replacement moiety. The skilled person is well aware that guanine, cytosine, adenine, and uracil may be replaced by other moieties without substantially altering the base pairing properties of an oligonucleotide comprising a nucleotide bearing such replacement moiety. For example, without limitation, a nucleotide comprising inosine as its base may base pair with nucleotides containing adenine, cytosine, or uracil. Hence, nucleotides containing uracil, guanine, or adenine may be replaced in the nucleotide sequences of the invention by a nucleotide containing, for example, inosine. Sequences comprising such replacement moieties are embodiments of the invention.

A "double stranded RNAi agent," double-stranded RNA (dsRNA) molecule, also referred to as "dsRNA agent," "dsRNA", "siRNA", "iRNA agent," as used interchangeably herein, refers to a complex of ribonucleic acid molecules, having a duplex structure comprising two anti-parallel and substantially complementary, as defined below, nucleic acid strands. In general, the majority of nucleotides of each strand are ribonucleotides, but as described in detail herein, each or both strands can also include one or more non-ribonucleotides, e.g., a deoxyribonucleotide and/or a modified nucleotide. In addition, as used in this specification, an "RNAi agent" may include ribonucleotides with chemical modifications; an RNAi agent may include substantial modifications at multiple nucleotides. Such modifications may include all types of modifications disclosed herein or known in the art. Any such modifications, as used in a siRNA type molecule, are encompassed by "RNAi agent" for the purposes of this specification and claims.

In another embodiment, the RNAi agent may be a single-stranded siRNA that is introduced into a cell or organism to inhibit a target mRNA. Single-stranded RNAi agents bind to the RISC endonuclease Argonaute 2, which then cleaves the target mRNA. The single-stranded siRNAs are generally 15-30 nucleotides and are chemically modified. The design and testing of single-stranded siRNAs are described in U.S. Pat. No. 8,101,348 and in Lima et al., (2012) *Cell* 150: 883-894, the entire contents of each of which are hereby incorporated herein by reference. Any of the antisense nucleotide sequences described herein may be used as a single-stranded siRNA as described herein or as chemically modified by the methods described in Lima et al., (2012) *Cell* 150; 883-894.

The two strands forming the duplex structure may be different portions of one larger RNA molecule, or they may be separate RNA molecules. Where the two strands are part of one larger molecule, and therefore are connected by an uninterrupted chain of nucleotides between the 3'-end of one strand and the 5'-end of the respective other strand forming the duplex structure, the connecting RNA chain is referred to as a "hairpin loop." Where the two strands are connected covalently by means other than an uninterrupted chain of nucleotides between the 3'-end of one strand and the 5'-end of the respective other strand forming the duplex structure, the connecting structure is referred to as a "linker." The RNA strands may have the same or a different number of nucleotides. The maximum number of base pairs is the number of nucleotides in the shortest strand of the dsRNA minus any overhangs that are present in the duplex. In addition to the duplex structure, an RNAi agent may comprise one or more nucleotide overhangs. The term "siRNA" is also used herein to refer to an RNAi agent as described above.

In another aspect, the agent is a single-stranded antisense RNA molecule. An antisense RNA molecule is complementary to a sequence within the target mRNA. Antisense RNA can inhibit translation in a stoichiometric manner by base pairing to the mRNA and physically obstructing the translation machinery, see Dias, N. et al., (2002) *Mol Cancer Ther* 1:347-355. The antisense RNA molecule may have about 15-30 nucleotides that are complementary to the target mRNA. For example, the antisense RNA molecule may have a sequence of at least 15, 16, 17, 18, 19, 20 or more contiguous nucleotides from one of the antisense sequences of Table 1.

As used herein, a "nucleotide overhang" refers to the unpaired nucleotide or nucleotides that protrude from the duplex structure of an RNAi agent when a 3'-end of one strand of the RNAi agent extends beyond the 5'-end of the other strand, or vice versa. "Blunt" or "blunt end" means that there are no unpaired nucleotides at that end of the double stranded RNAi agent, i.e., no nucleotide overhang. A "blunt ended" RNAi agent is a dsRNA that is double-stranded over its entire length, i.e., no nucleotide overhang at either end of the molecule. The RNAi agents of the invention include RNAi agents with nucleotide overhangs at one end (i.e., agents with one overhang and one blunt end) or with nucleotide overhangs at both ends.

The term "antisense strand" refers to the strand of a double stranded RNAi agent which includes a region that is substantially complementary to a target sequence (e.g., a human TTR mRNA). As used herein, the term "region complementary to part of an mRNA encoding transthyretin" refers to a region on the antisense strand that is substantially complementary to part of a TTR mRNA sequence. Where the region of complementarity is not fully complementary to the target sequence, the mismatches are most tolerated in the terminal regions and, if present, are generally in a terminal region or regions, e.g., within 6, 5, 4, 3, or 2 nucleotides of the 5' and/or 3' terminus.

The term "sense strand," as used herein, refers to the strand of a dsRNA that includes a region that is substantially complementary to a region of the antisense strand.

As used herein, the term "cleavage region" refers to a region that is located immediately adjacent to the cleavage site. The cleavage site is the site on the target at which cleavage occurs. In some embodiments, the cleavage region comprises three bases on either end of, and immediately adjacent to, the cleavage site. In some embodiments, the cleavage region comprises two bases on either end of, and immediately adjacent to, the cleavage site. In some embodiments, the cleavage site specifically occurs at the site bound by nucleotides 10 and 11 of the antisense strand, and the cleavage region comprises nucleotides 11, 12 and 13.

As used herein, and unless otherwise indicated, the term "complementary," when used to describe a first nucleotide sequence in relation to a second nucleotide sequence, refers to the ability of an oligonucleotide or polynucleotide comprising the first nucleotide sequence to hybridize and form a duplex structure under certain conditions with an oligonucleotide or polynucleotide comprising the second nucleotide sequence, as will be understood by the skilled person. Such conditions can, for example, be stringent conditions, where stringent conditions may include: 400 mM NaCl, 40 mM PIPES pH 6.4, 1 mM EDTA, 50° C. or 70° C. for 12-16 hours followed by washing. Other conditions, such as physiologically relevant conditions as may be encountered inside an organism, can apply. The skilled person will be able to determine the set of conditions most appropriate for a test of complementarity of two sequences in accordance with the ultimate application of the hybridized nucleotides.

Sequences can be "fully complementary" with respect to each when there is base-pairing of the nucleotides of the first nucleotide sequence with the nucleotides of the second nucleotide sequence over the entire length of the first and second nucleotide sequences. However, where a first sequence is referred to as "substantially complementary" with respect to a second sequence herein, the two sequences can be fully complementary, or they may form one or more, but generally not more than 4, 3 or 2 mismatched base pairs upon hybridization, while retaining the ability to hybridize under the conditions most relevant to their ultimate application. However, where two oligonucleotides are designed to form, upon hybridization, one or more single stranded overhangs, such overhangs shall not be regarded as mismatches with regard to the determination of complementarity. For example, a dsRNA comprising one oligonucleotide 21 nucleotides in length and another oligonucleotide 23 nucleotides in length, wherein the longer oligonucleotide comprises a sequence of 21 nucleotides that is fully complementary to the shorter oligonucleotide, may yet be referred to as "fully complementary" for the purposes described herein.

"Complementary" sequences, as used herein, may also include, or be formed entirely from, non-Watson-Crick base pairs and/or base pairs formed from non-natural and modified nucleotides, in as far as the above requirements with respect to their ability to hybridize are fulfilled. Such non-Watson-Crick base pairs includes, but not limited to, G:U Wobble or Hoogstein base pairing.

The terms "complementary," "fully complementary" and "substantially complementary" herein may be used with respect to the base matching between the sense strand and the antisense strand of a dsRNA, or between the antisense strand of a dsRNA and a target sequence, as will be understood from the context of their use.

As used herein, a polynucleotide that is "substantially complementary to at least part of" a messenger RNA (mRNA) refers to a polynucleotide that is substantially complementary to a contiguous portion of the mRNA of interest (e.g., an mRNA encoding TTR) including a 5' UTR, an open reading frame (ORF), or a 3' UTR. For example, a polynucleotide is complementary to at least a part of a TTR mRNA if the sequence is substantially complementary to a non-interrupted portion of an mRNA encoding TTR.

The term "inhibiting," as used herein, is used interchangeably with "reducing," "silencing," "downregulating," "suppressing" and other similar terms, and includes any level of inhibition.

The phrase "inhibiting expression of a TTR," as used herein, includes inhibition of expression of any TTR gene (such as, e.g., a mouse TTR gene, a rat TTR gene, a monkey TTR gene, or a human TTR gene) as well as variants or mutants of a TTR gene. Thus, the TTR gene may be a wild-type TTR gene, a mutant TTR gene (such as a mutant TTR gene giving rise to systemic amyloid deposition), or a transgenic TTR gene in the context of a genetically manipulated cell, group of cells, or organism.

"Inhibiting expression of a TTR gene" includes any level of inhibition of a TTR gene, e.g., at least partial suppression of the expression of a TTR gene, such as an inhibition of at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99%.

The expression of a TTR gene may be assessed based on the level of any variable associated with TTR gene expression, e.g., TTR mRNA level, TTR protein level, retinol binding protein level, vitamin A level, or the number or extent of amyloid deposits. Inhibition may be assessed by a decrease in an absolute or relative level of one or more of these variables compared with a control level. The control level may be any type of control level that is utilized in the art, e.g., a pre-dose baseline level, or a level determined from a similar subject, cell, or sample that is untreated or treated with a control (such as, e.g., buffer only control or inactive agent control).

The phrase "contacting a cell with an RNAi agent," as used herein, includes contacting a cell by any possible means. Contacting a cell with an RNAi agent, e.g., a double stranded RNAi agent, includes contacting a cell in vitro with the RNAi agent or contacting a cell in vivo with the RNAi agent. The contacting may be done directly or indirectly. Thus, for example, the RNAi agent may be put into physical contact with the cell by the individual performing the method, or alternatively, the RNAi agent may be put into a situation that will permit or cause it to subsequently come into contact with the cell.

Contacting a cell in vitro may be done, for example, by incubating the cell with the RNAi agent. Contacting a cell in vivo may be done, for example, by injecting the RNAi agent into or near the tissue where the cell is located, or by injecting the RNAi agent into another area, e.g., the bloodstream or the subcutaneous space, such that the agent will subsequently reach the tissue where the cell to be contacted is located. For example, the RNAi agent may contain and/or be coupled to a ligand, e.g., a GalNAc$_3$ ligand, that directs the RNAi agent to a site of interest, e.g., the liver. Combinations of in vitro and in vivo methods of contacting are also possible. In connection with the methods of the invention, a cell might also be contacted in vitro with an RNAi agent and subsequently transplanted into a subject.

A "patient" or "subject," as used herein, is intended to include either a human or non-human animal, preferably a mammal, e.g., a monkey. Most preferably, the subject or patient is a human.

A "TTR-associated disease," as used herein, is intended to include any disease associated with the TTR gene or protein. Such a disease may be caused, for example, by excess production of the TTR protein, by TTR gene mutations, by abnormal cleavage of the TTR protein, by abnormal interactions between TTR and other proteins or other endogenous or exogenous substances. A "TTR-associated disease" includes any type of TTR amyloidosis (ATTR) wherein TTR plays a role in the formation of abnormal extracellular aggregates or amyloid deposits. TTR-associated diseases include senile systemic amyloidosis (SSA), systemic familial amyloidosis, familial amyloidotic polyneuropathy (FAP), familial amyloidotic cardiomyopathy (FAC), leptomeningeal/Central Nervous System (CNS) amyloidosis, amyloidotic vitreous opacities, carpal tunnel syndrome, and hyperthyroxinemia. Symptoms of TTR amyloidosis include sensory neuropathy (e.g., paresthesia, hypesthesia in distal limbs), autonomic neuropathy (e.g., gastrointestinal dysfunction, such as gastric ulcer, or orthostatic hypotension), motor neuropathy, seizures, dementia, myelopathy, polyneuropathy, carpal tunnel syndrome, autonomic insufficiency, cardiomyopathy, vitreous opacities, renal insufficiency, nephropathy, substantially reduced mBMI (modified Body Mass Index), cranial nerve dysfunction, and corneal lattice dystrophy.

"Therapeutically effective amount," as used herein, is intended to include the amount of an RNAi agent that, when administered to a patient for treating a TTR associated disease, is sufficient to effect treatment of the disease (e.g., by diminishing, ameliorating or maintaining the existing disease or one or more symptoms of disease). The "therapeutically effective amount" may vary depending on the RNAi agent, how the agent is administered, the disease and its severity and the history, age, weight, family history, genetic makeup, stage of pathological processes mediated by TTR expression, the types of preceding or concomitant treatments, if any, and other individual characteristics of the patient to be treated.

"Prophylactically effective amount," as used herein, is intended to include the amount of an RNAi agent that, when administered to a subject who does not yet experience or display symptoms of a TTR-associated disease, but who may be predisposed to the disease, is sufficient to prevent or ameliorate the disease or one or more symptoms of the disease. Symptoms that may be ameliorated include sensory neuropathy (e.g., paresthesia, hypesthesia in distal limbs), autonomic neuropathy (e.g., gastrointestinal dysfunction, such as gastric ulcer, or orthostatic hypotension), motor neuropathy, seizures, dementia, myelopathy, polyneuropathy, carpal tunnel syndrome, autonomic insufficiency, cardiomyopathy, vitreous opacities, renal insufficiency, nephropathy, substantially reduced mBMI (modified Body Mass Index), cranial nerve dysfunction, and corneal lattice dystrophy. Ameliorating the disease includes slowing the course of the disease or reducing the severity of later-developing disease. The "prophylactically effective amount" may vary depending on the RNAi agent, how the agent is administered, the degree of risk of disease, and the history, age, weight, family history, genetic makeup, the types of preceding or concomitant treatments, if any, and other individual characteristics of the patient to be treated.

A "therapeutically-effective amount" or "prophylacticaly effective amount" also includes an amount of an RNAi agent that produces some desired local or systemic effect at a reasonable benefit/risk ratio applicable to any treatment. RNAi gents employed in the methods of the present invention may be administered in a sufficient amount to produce a reasonable benefit/risk ratio applicable to such treatment.

The term "sample," as used herein, includes a collection of similar fluids, cells, or tissues isolated from a subject, as well as fluids, cells, or tissues present within a subject. Examples of biological fluids include blood, serum and serosal fluids, plasma, cerebrospinal fluid, ocular fluids, lymph, urine, saliva, and the like. Tissue samples may include samples from tissues, organs or localized regions. For example, samples may be derived from particular organs, parts of organs, or fluids or cells within those organs. In certain embodiments, samples may be derived from the liver (e.g., whole liver or certain segments of liver or certain types of cells in the liver, such as, e.g., hepatocytes), the retina or parts of the retina (e.g., retinal pigment epithelium), the central nervous system or parts of the central nervous system (e.g., ventricles or choroid plexus), or the pancreas or certain cells or parts of the pancreas. In some embodiments, a "sample derived from a subject" refers to cerebrospinal fluid obtained from the subject. In preferred embodiments, a "sample derived from a subject" refers to blood or plasma drawn from the subject. In further embodiments, a "sample derived from a subject" refers to liver tissue (or subcomponents thereof) or retinal tissue (or subcomponents thereof) derived from the subject.

II. RNAi Agents

The present invention provides RNAi agents with superior gene silencing activity. It is shown herein and in Provisional Application No. 61/561,710 (to which the present application claims priority) that a superior result may be obtained by introducing one or more motifs of three identical modifications on three consecutive nucleotides into a sense strand and/or antisense strand of a RNAi agent, particularly at or near the cleavage site. The sense strand and antisense strand of the RNAi agent may otherwise be completely modified. The introduction of these motifs interrupts the modification pattern, if present, of the sense and/or antisense strand. The RNAi agent also optionally conjugates with a GalNAc derivative ligand, for instance on the sense strand. The resulting RNAi agents present superior gene silencing activity.

The inventors surprisingly discovered that when the sense strand and antisense strand of the RNAi agent are completely modified, having one or more motifs of three identical modifications on three consecutive nucleotides at or near the cleavage site of at least one strand of a RNAi agent superiorly enhanced the gene silencing activity of the RNAi agent.

Accordingly, the invention provides RNAi agents, e.g., double stranded RNAi agents, capable of inhibiting the expression of a target gene (i.e., a TTR gene) in vivo. The RNAi agent comprises a sense strand and an antisense strand. Each strand of the RNAi agent can range from 12-30 nucleotides in length. For example, each strand can be between 14-30 nucleotides in length, 17-30 nucleotides in length, 25-30 nucleotides in length, 27-30 nucleotides in length, 17-23 nucleotides in length, 17-21 nucleotides in length, 17-19 nucleotides in length, 19-25 nucleotides in length, 19-23 nucleotides in length, 19-21 nucleotides in length, 21-25 nucleotides in length, or 21-23 nucleotides in length.

The sense strand and antisense strand typically form a duplex double stranded RNA ("dsRNA"), also referred to herein as an "RNAi agent." The duplex region of an RNAi agent may be 12-30 nucleotide pairs in length. For example, the duplex region can be between 14-30 nucleotide pairs in length, 17-30 nucleotide pairs in length, 27-30 nucleotide pairs in length, 17-23 nucleotide pairs in length, 17-21 nucleotide pairs in length, 17-19 nucleotide pairs in length, 19-25 nucleotide pairs in length, 19-23 nucleotide pairs in length, 19-21 nucleotide pairs in length, 21-25 nucleotide pairs in length, or 21-23 nucleotide pairs in length. In another example, the duplex region is selected from 15, 16, 17, 18, 19, 20, 21, 22, 23, 24, 25, 26, and 27.

In one embodiment, the RNAi agent may contain one or more overhang regions and/or capping groups of RNAi agent at 3'-end, or 5'-end or both ends of a strand. The overhang can be 1-6 nucleotides in length, for instance 2-6 nucleotides in length, 1-5 nucleotides in length, 2-5 nucleotides in length, 1-4 nucleotides in length, 2-4 nucleotides in length, 1-3 nucleotides in length, 2-3 nucleotides in length, or 1-2 nucleotides in length. The overhangs can be the result of one strand being longer than the other, or the result of two strands of the same length being staggered. The overhang can form a mismatch with the target mRNA or it can be complementary to the gene sequences being targeted or can be other sequence. The first and second strands can also be joined, e.g., by additional bases to form a hairpin, or by other non-base linkers.

The RNAi agents provided by the present invention include agents with chemical modifications as disclosed, for example, in U.S. Provisional Application No. 61/561,710, filed on Nov. 18, 2011, International Application No. PCT/US2011/051597, filed on Sep. 15, 2010, and PCT Publication WO 2009/073809, the entire contents of each of which are incorporated herein by reference.

In one embodiment, the nucleotides in the overhang region of the RNAi agent can each independently be a modified or unmodified nucleotide including, but no limited to 2'-sugar modified, such as, 2-F, 2'-O-methyl, thymidine (T), 2'-O-methoxyethyl-5-methyluridine (Teo), 2'-O-methoxyethyladenosine (Aeo), 2'-O-methoxyethyl-5-methylcytidine (m5Ceo), and any combinations thereof. For example, TT can be an overhang sequence for either end on either strand. The overhang can form a mismatch with the target mRNA or it can be complementary to the gene sequences being targeted or can be other sequence.

The 5'- or 3'-overhangs at the sense strand, antisense strand or both strands of the RNAi agent may be phosphorylated. In some embodiments, the overhang region contains two nucleotides having a phosphorothioate between the two nucleotides, where the two nucleotides can be the same or different. In one embodiment, the overhang is present at the 3'-end of the sense strand, antisense strand or both strands. In one embodiment, this 3'-overhang is present in the antisense strand. In one embodiment, this 3'-overhang is present in the sense strand.

The RNAi agent may contain only a single overhang, which can strengthen the interference activity of the RNAi, without affecting its overall stability. For example, the single-stranded overhang is located at the 3'-terminal end of the sense strand or, alternatively, at the 3'-terminal end of the antisense strand. The RNAi may also have a blunt end, located at the 5'-end of the antisense strand (or the 3'-end of the sense strand) or vice versa. Generally, the antisense strand of the RNAi has a nucleotide overhang at the 3'-end, and the 5'-end is blunt. While the Applicants are not bound by theory, the theoretical mechanism is that the asymmetric blunt end at the 5'-end of the antisense strand and 3'-end overhang of the antisense strand favor the guide strand loading into RISC process.

In one embodiment, the RNAi agent is a double ended bluntmer of 19 nt in length, wherein the sense strand contains at least one motif of three 2'-F modifications on three consecutive nucleotides at positions 7,8,9 from the 5' end. The antisense strand contains at least one motif of three 2'-O-methyl modifications on three consecutive nucleotides at positions 11, 12, 13 from the 5' end.

In one embodiment, the RNAi agent is a double ended bluntmer of 20 nt in length, wherein the sense strand contains at least one motif of three 2'-F modifications on three consecutive nucleotides at positions 8,9,10 from the 5' end. The antisense strand contains at least one motif of three 2'-O-methyl modifications on three consecutive nucleotides at positions 11, 12, 13 from the 5' end.

In one embodiment, the RNAi agent is a double ended bluntmer of 21 nt in length, wherein the sense strand contains at least one motif of three 2'-F modifications on three consecutive nucleotides at positions 9, 10, 11 from the 5' end. The antisense strand contains at least one motif of three 2'-O-methyl modifications on three consecutive nucleotides at positions 11, 12, 13 from the 5' end.

In one embodiment, the RNAi agent comprises a 21 nucleotides (nt) sense strand and a 23 nucleotides (nt) antisense strand, wherein the sense strand contains at least one motif of three 2'-F modifications on three consecutive nucleotides at positions 9,10,11 from the 5' end; the antisense strand contains at least one motif of three 2'-O-methyl modifications on three consecutive nucleotides at positions 11, 12, 13 from the 5' end, wherein one end of the RNAi agent is blunt, while the other end comprises a 2 nt overhang. Preferably, the 2 nt overhang is at the 3'-end of the antisense. Optionally, the RNAi agent further comprises a ligand (preferably GalNAc$_3$).

In one embodiment, the RNAi agent comprises a sense and an antisense strand, wherein the sense strand is 25-30 nucleotide residues in length, wherein starting from the 5' terminal nucleotide (position 1) positions 1 to 23 of the first strand comprise at least 8 ribonucleotides; antisense strand is 36-66 nucleotide residues in length and, starting from the 3' terminal nucleotide, comprises at least 8 ribonucleotides in the positions paired with positions 1-23 of sense strand to form a duplex; wherein at least the 3' terminal nucleotide of antisense strand is unpaired with sense strand, and up to 6 consecutive 3' terminal nucleotides are unpaired with sense strand, thereby forming a 3' single stranded overhang of 1-6 nucleotides; wherein the 5' terminus of antisense strand comprises from 10-30 consecutive nucleotides which are unpaired with sense strand, thereby forming a 10-30 nucleotide single stranded 5' overhang; wherein at least the sense strand 5' terminal and 3' terminal nucleotides are base paired with nucleotides of antisense strand when sense and antisense strands are aligned for maximum complementarity, thereby forming a substantially duplexed region between sense and antisense strands; and antisense strand is sufficiently complementary to a target RNA along at least 19 ribonucleotides of antisense strand length to reduce target gene expression when the double stranded nucleic acid is introduced into a mammalian cell; and wherein the sense strand contains at least one motif of three 2'-F modifications on three consecutive nucleotides, where at least one of the motifs occurs at or near the cleavage site. The antisense strand contains at least one motif of three 2'-O-methyl modifications on three consecutive nucleotides at or near the cleavage site.

In one embodiment, the RNAi agent comprises sense and antisense strands, wherein the RNAi agent comprises a first strand having a length which is at least 25 and at most 29 nucleotides and a second strand having a length which is at most 30 nucleotides with at least one motif of three 2'-O-methyl modifications on three consecutive nucleotides at position 11,12,13 from the 5' end; wherein the 3' end of the first strand and the 5' end of the second strand form a blunt end and the second strand is 1-4 nucleotides longer at its 3' end than the first strand, wherein the duplex region which is at least 25 nucleotides in length, and the second strand is sufficiently complementary to a target mRNA along at least 19 nt of the second strand length to reduce target gene expression when the RNAi agent is introduced into a mammalian cell, and wherein dicer cleavage of the RNAi agent preferentially results in an siRNA comprising the 3' end of the second strand, thereby reducing expression of the target gene in the mammal. Optionally, the RNAi agent further comprises a ligand.

In one embodiment, the sense strand of the RNAi agent contains at least one motif of three identical modifications on three consecutive nucleotides, where one of the motifs occurs at the cleavage site in the sense strand.

In one embodiment, the antisense strand of the RNAi agent can also contain at least one motif of three identical modifications on three consecutive nucleotides, where one of the motifs occurs at or near the cleavage site in the antisense strand For RNAi agent having a duplex region of 17-23 nt in length, the cleavage site of the antisense strand is typically around the 10, 11 and 12 positions from the 5'-end. Thus, the motifs of three identical modifications may occur at the 9, 10, 11 positions; 10, 11, 12 positions; 11, 12, 13 positions; 12, 13, 14 positions; or 13, 14, 15 positions of the antisense strand, the count starting from the $1^{st}$ nucleotide from the 5'-end of the antisense strand, or, the count starting from the $1^{st}$ paired nucleotide within the duplex region from the 5'-end of the antisense strand. The cleavage site in the antisense strand may also change according to the length of the duplex region of the RNAi from the 5'-end.

The sense strand of the RNAi agent may contain at least one motif of three identical modifications on three consecutive nucleotides at the cleavage site of the strand; and the antisense strand may have at least one motif of three identical modifications on three consecutive nucleotides at or near the cleavage site of the strand. When the sense strand and the antisense strand form a dsRNA duplex, the sense strand and the antisense strand can be so aligned that one motif of the three nucleotides on the sense strand and one motif of the three nucleotides on the antisense strand have at least one nucleotide overlap, i.e., at least one of the three nucleotides of the motif in the sense strand forms a base pair with at least one of the three nucleotides of the motif in the antisense strand. Alternatively, at least two nucleotides may overlap, or all three nucleotides may overlap.

In one embodiment, the sense strand of the RNAi agent may contain more than one motif of three identical modifications on three consecutive nucleotides. The first motif should occur at or near the cleavage site of the strand and the other motifs may be wing modifications. The term "wing modification" herein refers to a motif occurring at another portion of the strand that is separated from the motif at or near the cleavage site of the same strand. The wing modification is either adjacent to the first motif or is separated by at least one or more nucleotides. When the motifs are immediately adjacent to each other than the chemistry of the motifs are distinct from each other and when the motifs are separated by one or more nucleotide than the chemistries can be the same or different. Two or more wing modifications may be present. For instance, when two wing modifications are present, each wing modification may occur at one end relative to the first motif which is at or near cleavage site or on either side of the lead motif.

Like the sense strand, the antisense strand of the RNAi agent may contain at least two motifs of three identical modifications on three consecutive nucleotides, with at least one of the motifs occurring at or near the cleavage site of the strand. This antisense strand may also contain one or more wing modifications in an alignment similar to the wing modifications that is present on the sense strand.

In one embodiment, the wing modification on the sense strand or antisense strand of the RNAi agent typically does not include the first one or two terminal nucleotides at the 3'-end, 5'-end or both ends of the strand.

In another embodiment, the wing modification on the sense strand or antisense strand of the RNAi agent typically does not include the first one or two paired nucleotides within the duplex region at the 3'-end, 5'-end or both ends of the strand.

When the sense strand and the antisense strand of the RNAi agent each contain at least one wing modification, the wing modifications may fall on the same end of the duplex region, and have an overlap of one, two or three nucleotides.

When the sense strand and the antisense strand of the RNAi agent each contain at least two wing modifications, the sense strand and the antisense strand can be so aligned that two modifications each from one strand fall on one end of the duplex region, having an overlap of one, two or three nucleotides; two modifications each from one strand fall on the other end of the duplex region, having an overlap of one, two or three nucleotides; two modifications one strand fall on each side of the lead motif, having an overlap of one, two or three nucleotides in the duplex region.

In one embodiment, every nucleotide in the sense strand and antisense strand of the RNAi agent, including the nucleotides that are part of the motifs, may be modified. Each nucleotide may be modified with the same or different modification which can include one or more alteration of one or both of the non-linking phosphate oxygens and/or of one or more of the linking phosphate oxygens; alteration of a constituent of the ribose sugar, e.g., of the 2' hydroxyl on the ribose sugar; wholesale replacement of the phosphate moiety with "dephospho" linkers; modification or replacement of a naturally occurring base; and replacement or modification of the ribose-phosphate backbone.

As nucleic acids are polymers of subunits, many of the modifications occur at a position which is repeated within a nucleic acid, e.g., a modification of a base, or a phosphate moiety, or a non-linking O of a phosphate moiety. In some cases the modification will occur at all of the subject positions in the nucleic acid but in many cases it will not. By way of example, a modification may only occur at a 3' or 5' terminal position, may only occur in a terminal region, e.g., at a position on a terminal nucleotide or in the last 2, 3, 4, 5, or 10 nucleotides of a strand. A modification may occur in a double strand region, a single strand region, or in both. A modification may occur only in the double strand region of a RNA or may only occur in a single strand region of a RNA. For example, a phosphorothioate modification at a non-linking O position may only occur at one or both termini, may only occur in a terminal region, e.g., at a position on a terminal nucleotide or in the last 2, 3, 4, 5, or 10 nucleotides of a strand, or may occur in double strand and single strand regions, particularly at termini. The 5' end or ends can be phosphorylated.

It may be possible, e.g., to enhance stability, to include particular bases in overhangs, or to include modified nucleotides or nucleotide surrogates, in single strand overhangs, e.g., in a 5' or 3' overhang, or in both. For example, it can be desirable to include purine nucleotides in overhangs. In some embodiments all or some of the bases in a 3' or 5' overhang may be modified, e.g., with a modification described herein. Modifications can include, e.g., the use of modifications at the 2' position of the ribose sugar with modifications that are known in the art, e.g., the use of deoxyribonucleotides, 2'-deoxy-2'-fluoro (2'-F) or 2'-O-methyl modified instead of the ribosugar of the nucleobase, and modifications in the phosphate group, e.g., phosphorothioate modifications. Overhangs need not be homologous with the target sequence.

In one embodiment, each residue of the sense strand and antisense strand is independently modified with LNA, HNA, CeNA, 2'-methoxyethyl, 2'-O-methyl, 2'-β-allyl, 2'-C-allyl, 2'-deoxy, 2'-hydroxyl, or 2'-fluoro. The strands can contain more than one modification. In one embodiment, each residue of the sense strand and antisense strand is independently modified with 2'-O-methyl or 2'-fluoro.

At least two different modifications are typically present on the sense strand and antisense strand. Those two modifications may be the 2'-O-methyl or 2'-fluoro modifications, or others.

In one embodiment, the $N_a$ and/or $N_b$ comprise modifications of an alternating pattern. The term "alternating motif" as used herein refers to a motif having one or more modifications, each modification occurring on alternating nucleotides of one strand. The alternating nucleotide may refer to one per every other nucleotide or one per every three nucleotides, or a similar pattern. For example, if A, B and C each represent one type of modification to the nucleotide, the alternating motif can be "ABABABABABAB . . . ," "AABBAAB-BAABB . . . ," "AABAABAABAAB . . . ," "AAABAAA-BAAAB . . . ," "AAABBBAAABBB . . . ," or "ABCABCAB-CABC . . . ," etc.

The type of modifications contained in the alternating motif may be the same or different. For example, if A, B, C, D each represent one type of modification on the nucleotide, the alternating pattern, i.e., modifications on every other nucleotide, may be the same, but each of the sense strand or antisense strand can be selected from several possibilities of modifications within the alternating motif such as "ABA-BAB . . . ", "ACACAC . . . " "BDBDBD . . . " or "CDC-DCD . . . ," etc.

In one embodiment, the RNAi agent of the invention comprises the modification pattern for the alternating motif on the sense strand relative to the modification pattern for the alternating motif on the antisense strand is shifted. The shift may be such that the modified group of nucleotides of the sense strand corresponds to a differently modified group of nucleotides of the antisense strand and vice versa. For example, the sense strand when paired with the antisense strand in the dsRNA duplex, the alternating motif in the sense strand may start with "ABABAB" from 5'-3' of the strand and the alternating motif in the antisense strand may start with "BABABA" from 5'-3' of the strand within the duplex region. As another example, the alternating motif in the sense strand may start with "AABBAABB" from 5'-3' of the strand and the alternating motif in the antisense strand may start with "BBAABBAA" from 5'-3' of the strand within the duplex region, so that there is a complete or partial shift of the modification patterns between the sense strand and the antisense strand.

In one embodiment, the RNAi agent comprises the pattern of the alternating motif of 2'-O-methyl modification and 2'-F modification on the sense strand initially has a shift relative to the pattern of the alternating motif of 2'-O-methyl modification and 2'-F modification on the antisense strand initially, i.e., the 2'-O-methyl modified nucleotide on the sense strand base pairs with a 2'-F modified nucleotide on the antisense strand and vice versa. The 1 position of the sense strand may start with the 2'-F modification, and the 1 position of the antisense strand may start with the 2'-O-methyl modification.

The introduction of one or more motifs of three identical modifications on three consecutive nucleotides to the sense strand and/or antisense strand interrupts the initial modification pattern present in the sense strand and/or antisense strand. This interruption of the modification pattern of the sense and/or antisense strand by introducing one or more motifs of three identical modifications on three consecutive nucleotides to the sense and/or antisense strand surprisingly enhances the gene silencing activity to the target gene.

In one embodiment, when the motif of three identical modifications on three consecutive nucleotides is introduced to any of the strands, the modification of the nucleotide next to the motif is a different modification than the modification of the motif. For example, the portion of the sequence containing the motif is " . . . $N_a$YYYN$_b$ . . . ," where "Y" represents the modification of the motif of three identical modifications on three consecutive nucleotide, and "$N_a$" and "$N_b$" represent a modification to the nucleotide next to the motif "YYY" that is different than the modification of Y, and where $N_a$ and $N_b$ can be the same or different modifications. Alternatively, $N_a$ and/or $N_b$ may be present or absent when there is a wing modification present.

The RNAi agent may further comprise at least one phosphorothioate or methylphosphonate internucleotide linkage. The phosphorothioate or methylphosphonate internucleotide linkage modification may occur on any nucleotide of the sense strand or antisense strand or both in any position of the strand. For instance, the internucleotide linkage modification may occur on every nucleotide on the sense strand or antisense strand; each internucleotide linkage modification may occur in an alternating pattern on the sense strand or antisense strand; or the sense strand or antisense strand may contain both internucleotide linkage modifications in an alternating pattern. The alternating pattern of the internucleotide linkage modification on the sense strand may be the same or different from the antisense strand, and the alternating pattern of the internucleotide linkage modification on the sense strand may have a shift relative to the alternating pattern of the internucleotide linkage modification on the antisense strand.

In one embodiment, the RNAi comprises the phosphorothioate or methylphosphonate internucleotide linkage modification in the overhang region. For example, the overhang region may contain two nucleotides having a phosphorothioate or methylphosphonate internucleotide linkage between the two nucleotides. Internucleotide linkage modifications also may be made to link the overhang nucleotides with the terminal paired nucleotides within duplex region. For example, at least 2, 3, 4, or all the overhang nucleotides may be linked through phosphorothioate or methylphosphonate internucleotide linkage, and optionally, there may be additional phosphorothioate or methylphosphonate internucleotide linkages linking the overhang nucleotide with a paired nucleotide that is next to the overhang nucleotide. For instance, there may be at least two phosphorothioate internucleotide linkages between the terminal three nucleotides, in which two of the three nucleotides are overhang nucleotides, and the third is a paried nucleotide next to the overhang nucleotide. Preferably, these terminal three nucleotides may be at the 3'-end of the antisense strand.

In one embodiment, the RNAi agent comprises mismatch(es) with the target, within the duplex, or combinations thereof. The mistmatch can occur in the overhang region or the duplex region. The base pair can be ranked on the basis of their propensity to promote dissociation or melting (e.g., on the free energy of association or dissociation of a particular pairing, the simplest approach is to examine the pairs on an individual pair basis, though next neighbor or similar analysis can also be used). In terms of promoting dissociation: A:U is preferred over G:C; G:U is preferred over G:C; and I:C is preferred over G:C (I=inosine). Mismatches, e.g., non-canonical or other than canonical pairings (as described elsewhere herein) are preferred over canonical (A:T, A:U, G:C) pairings; and pairings which include a universal base are preferred over canonical pairings.

In one embodiment, the RNAi agent comprises at least one of the first 1, 2, 3, 4, or 5 base pairs within the duplex regions from the 5'-end of the antisense strand can be chosen independently from the group of: A:U, G:U, I:C, and mismatched pairs, e.g., non-canonical or other than canonical pairings or pairings which include a universal base, to promote the dissociation of the antisense strand at the 5'-end of the duplex.

In one embodiment, the nucleotide at the 1 position within the duplex region from the 5'-end in the antisense strand is selected from the group consisting of A, dA, dU, U, and dT. Alternatively, at least one of the first 1, 2 or 3 base pair within the duplex region from the 5'-end of the antisense strand is an AU base pair. For example, the first base pair within the duplex region from the 5'-end of the antisense strand is an AU base pair.

In one embodiment, the sense strand sequence may be represented by formula (I):

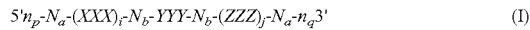

wherein:
i and j are each independently 0 or 1;
p and q are each independently 0-6;
each $N_a$ independently represents an oligonucleotide sequence comprising 0-25 modified nucleotides, each sequence comprising at least two differently modified nucleotides;
each $N_b$ independently represents an oligonucleotide sequence comprising 0-10 modified nucleotides;
each $n_p$ and $n_q$ independently represent an overhang nucleotide;
wherein Nb and Y do not have the same modification; and
XXX, YYY and ZZZ each independently represent one motif of three identical modifications on three consecutive nucleotides. Preferably YYY is all 2'-F modified nucleotides.

In one embodiment, the $N_a$ and/or $N_b$ comprise modifications of alternating pattern.

In one embodiment, the YYY motif occurs at or near the cleavage site of the sense strand. For example, when the RNAi agent has a duplex region of 17-23 nucleotides in length, the YYY motif can occur at or the vicinity of the cleavage site (e.g.: can occur at positions 6, 7, 8, 7, 8, 9, 8, 9, 10, 9, 10, 11, 10, 11, 12 or 11, 12, 13) of—the sense strand, the count starting from the 1st nucleotide, from the 5'-end; or optionally, the count starting at the 1st paired nucleotide within the duplex region, from the 5'-end.

In one embodiment, i is 1 and j is 0, or i is 0 and j is 1, or both i and j are 1. The sense strand can therefore be represented by the following formulas:

 (Ia);

 (Ib); or

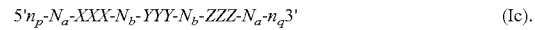 (Ic).

When the sense strand is represented by formula (Ia), $N_b$ represents an oligonucleotide sequence comprising 0-10, 0-7, 0-5, 0-4, 0-2 or 0 modified nucleotides. Each $N_a$ independently can represent an oligonucleotide sequence comprising 2-20, 2-15, or 2-10 modified nucleotides.

When the sense strand is represented as formula (Ib), $N_b$ represents an oligonucleotide sequence comprising 0-10, 0-7, 0-10, 0-7, 0-5, 0-4, 0-2 or 0 modified nucleotides. Each $N_a$ can independently represent an oligonucleotide sequence comprising 2-20, 2-15, or 2-10 modified nucleotides.

When the sense strand is represented as formula (Ic), each $N_b$ independently represents an oligonucleotide sequence comprising 0-10, 0-7, 0-5, 0-4, 0-2 or 0 modified nucleotides. Preferably, $N_b$ is 0, 1, 2, 3, 4, 5 or 6 Each $N_a$ can independently represent an oligonucleotide sequence comprising 2-20, 2-15, or 2-10 modified nucleotides.

Each of X, Y and Z may be the same or different from each other.

In one embodiment, the antisense strand sequence of the RNAi may be represented by formula (II):

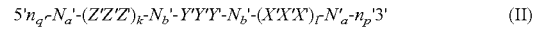 (II)

wherein:
k and l are each independently 0 or 1;
p' and q' are each independently 0-6;
each $N_a'$ independently represents an oligonucleotide sequence comprising 0-25 modified nucleotides, each sequence comprising at least two differently modified nucleotides;
each $N_b'$ independently represents an oligonucleotide sequence comprising 0-10 modified nucleotides;
each $n_p'$ and $n_q'$ independently represent an overhang nucleotide;
wherein $N_b'$ and Y' do not have the same modification; and
X'X'X', Y'Y'Y' and Z'Z'Z' each independently represent one motif of three identical modifications on three consecutive nucleotides.

In one embodiment, the $N_a'$ and/or $N_b'$ comprise modifications of alternating pattern.

The Y'Y'Y' motif occurs at or near the cleavage site of the antisense strand. For example, when the RNAi agent has a duplex region of 17-23 nt in length, the Y'Y'Y' motif can occur at positions 9, 10, 11; 10, 11, 12; 11, 12, 13; 12, 13, 14; or 13, 14, 15 of the antisense strand, with the count starting from the 1st nucleotide, from the 5'-end; or optionally, the count starting at the 1st paired nucleotide within the duplex region, from the 5'-end. Preferably, the Y'Y'Y' motif occurs at positions 11, 12, 13.

In one embodiment, Y'Y'Y' motif is all 2'-OMe modified nucleotides.

In one embodiment, k is 1 and l is 0, or k is 0 and l is 1, or both k and l are 1.

The antisense strand can therefore be represented by the following formulas:

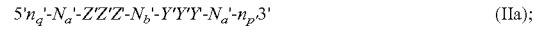 (IIa);

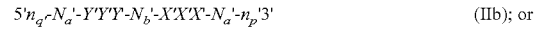 (IIb); or

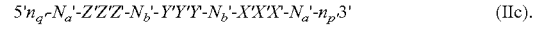 (IIc).

When the antisense strand is represented by formula (IIa), $N_b$ represents an oligonucleotide sequence comprising 0-10, 0-7, 0-10, 0-7, 0-5, 0-4, 0-2 or 0 modified nucleotides. Each $N_a'$ independently represents an oligonucleotide sequence comprising 2-20, 2-15, or 2-10 modified nucleotides.

When the antisense strand is represented as formula (IIb), $N_b'$ represents an oligonucleotide sequence comprising 0-10, 0-7, 0-10, 0-7, 0-5, 0-4, 0-2 or 0 modified nucleotides. Each $N_a'$ independently represents an oligonucleotide sequence comprising 2-20, 2-15, or 2-10 modified nucleotides.

When the antisense strand is represented as formula (IIc), each $N_b'$ independently represents an oligonucleotide sequence comprising 0-10, 0-7, 0-10, 0-7, 0-5, 0-4, 0-2 or 0 modified nucleotides. Each $N_a'$ independently represents an oligonucleotide sequence comprising 2-20, 2-15, or 2-10 modified nucleotides. Preferably, $N_b$ is 0, 1, 2, 3, 4, 5 or 6.

Each of X', Y' and Z' may be the same or different from each other.

Each nucleotide of the sense strand and antisense strand may be independently modified with LNA, HNA, CeNA, 2'-methoxyethyl, 2'-O-methyl, 2'-O-allyl, 2'-C-allyl, 2'-hydroxyl, 2'-deoxy or 2'-fluoro. For example, each nucleotide of the sense strand and antisense strand is independently modified with 2'-O-methyl or 2'-fluoro. Each X, Y, Z, X', Y' and Z', in particular, may represent a 2'-O-methyl modification or a 2'-fluoro modification.

In one embodiment, the sense strand of the RNAi agent may contain YYY motif occurring at 9, 10 and 11 positions of the strand when the duplex region is 21 nt, the count starting from the 1$^{st}$ nucleotide from the 5'-end, or optionally, the count starting at the 1$^{st}$ paired nucleotide within the duplex region, from the 5'-end; and Y represents 2'-F modification. The sense strand may additionally contain XXX motif or ZZZ motifs as wing modifications at the opposite end of the duplex region; and XXX and ZZZ each independently represents a 2'-OMe modification or 2'-F modification.

In one embodiment the antisense strand may contain Y'Y'Y' motif occurring at positions 11, 12, 13 of the strand, the count starting from the 1$^{st}$ nucleotide from the 5'-end, or optionally, the count starting at the 1$^{st}$ paired nucleotide within the duplex region, from the 5'-end; and Y' represents 2'-O-methyl modification. The antisense strand may additionally contain X'X'X' motif or Z'Z'Z' motifs as wing modifications at the opposite end of the duplex region; and X'X'X' and Z'Z'Z' each independently represents a 2'-OMe modification or 2'-F modification.

The sense strand represented by any one of the above formulas (Ia), (Ib) and (Ic) forms a duplex with a antisense strand being represented by any one of formulas (IIa), (IIb) and (IIc), respectively.

Accordingly, the RNAi agents of the invention may comprise a sense strand and an antisense strand, each strand having 14 to 30 nucleotides, the RNAi duplex represented by formula (III):

$$\text{sense: } 5' \; n_p \text{-} N_a \text{-} (X\;X\;X)_i \text{-} N_b \text{-} Y\;Y\;Y \text{-} N_b \text{-} (Z\;Z\;Z)_j \text{-} N_a \text{-} n_q \; 3' \quad \text{(III)}$$

$$\text{antisense: } 3' \; n_p' \text{-} N_a' \text{-} (X'X'X')_k \text{-} N_b' \text{-} Y'Y'Y' \text{-} N_b' \text{-} (Z'Z'Z')_l \text{-} N_a' \text{-} n_q' \; 5'$$

wherein:

j, k, and l are each independently 0 or 1;

p, p', q, and q' are each independently 0-6;

each $N_a$ and $N_a'$ independently represents an oligonucleotide sequence comprising 0-25 modified nucleotides, each sequence comprising at least two differently modified nucleotides;

each $N_b$ and $N_b'$ independently represents an oligonucleotide sequence comprising 0-10 modified nucleotides;

wherein each $n_p'$, $n_p$, $n_q'$, and $n_q$ independently represents an overhang nucleotide; and XXX, YYY, ZZZ, X'X'X', Y'Y'Y', and Z'Z'Z' each independently represent one motif of three identical modifications on three consecutive nucleotides.

In one embodiment, i is 1 and j is 0; or i is 0 and j is 1; or both i and j are 1. In another embodiment, k is 1 and l is 0; k is 0 and l is 1; or both k and l are 1.

Exemplary combinations of the sense strand and antisense strand forming a RNAi duplex include the formulas below:

$$5' \; n_p \text{-} N_a \text{-} Y\;Y\;Y \text{-} N_b \text{-} Z\;Z\;Z \text{-} N_a \text{-} n_q \; 3' \quad \text{(IIIa)}$$
$$3' \; n_p' \text{-} N_a' \text{-} Y'Y'Y' \text{-} N_b' \text{-} Z'Z'Z' \text{-} N_a' \text{-} n_q' \; 5'$$

$$5' \; n_p \text{-} N_a \text{-} X\;X\;X \text{-} N_b \text{-} Y\;Y\;Y \text{-} N_a \text{-} n_q \; 3' \quad \text{(IIIb)}$$
$$3' \; n_p' \text{-} N_a' \text{-} X'X'X' \text{-} N_b' \text{-} Y'Y'Y' \text{-} N_a' \text{-} n_q' \; 5'$$

$$5' \; n_p \text{-} N_a \text{-} X\;X\;X \text{-} N_b \text{-} Y\;Y\;Y \text{-} N_b \text{-} Z\;Z\;Z \text{-} N_a \text{-} n_q \; 3' \quad \text{(IIIc)}$$
$$3' \; n_p' \text{-} N_a' \text{-} X'X'X' \text{-} N_b' \text{-} Y'Y'Y' \text{-} N_b' \text{-} Z'Z'Z' \text{-} N_a' \text{-} n_q' \; 5'$$

When the RNAi agent is represented by formula (IIIa), each $N_b$ independently represents an oligonucleotide sequence comprising 1-10, 1-7, 1-5 or 1-4 modified nucleotides. Each $N_a$ independently represents an oligonucleotide sequence comprising 2-20, 2-15, or 2-10 modified nucleotides.

When the RNAi agent is represented as formula (IIIb), each $N_b$, $N_b'$ independently represents an oligonucleotide sequence comprising 0-10, 0-7, 0-10, 0-7, 0-5, 0-4, 0-2 or 0 modified nucleotides. Each $N_a$ independently represents an oligonucleotide sequence comprising 2-20, 2-15, or 2-10 modified nucleotides.

When the RNAi agent is represented as formula (IIIc), each $N_b$, $N_b'$ independently represents an oligonucleotide sequence comprising 0-10, 0-7, 0-10, 0-7, 0-5, 0-4, 0-2 or 0 modified nucleotides. Each $N_a$, $N_a'$ independently represents an oligonucleotide sequence comprising 2-20, 2-15, or 2-10 modified nucleotides. Each of $N_a$, $N_a'$, $N_b$ and $N_b'$ independently comprises modifications of alternating pattern.

Each of X, Y and Z in formulas (III), (IIIa), (IIIb) and (IIIc) may be the same or different from each other.

When the RNAi agent is represented by formula (III), (IIIa), (IIIb) or (IIIc), at least one of the Y nucleotides may form a base pair with one of the Y' nucleotides. Alternatively, at least two of the Y nucleotides form base pairs with the corresponding Y' nucleotides; or all three of the Y nucleotides all form base pairs with the corresponding Y' nucleotides.

When the RNAi agent is represented by formula (IIIa) or (IIIc), at least one of the Z nucleotides may form a base pair with one of the Z' nucleotides. Alternatively, at least two of the Z nucleotides form base pairs with the corresponding Z' nucleotides; or all three of the Z nucleotides all form base pairs with the corresponding Z' nucleotides.

When the RNAi agent is represented as formula (IIIb) or (IIIc), at least one of the X nucleotides may form a base pair with one of the X' nucleotides. Alternatively, at least two of the X nucleotides form base pairs with the corresponding X' nucleotides; or all three of the X nucleotides all form base pairs with the corresponding X' nucleotides.

In one embodiment, the modification on the Y nucleotide is different than the modification on the Y' nucleotide, the modification on the Z nucleotide is different than the modification on the Z' nucleotide, and/or the modification on the X nucleotide is different than the modification on the X' nucleotide.

In one embodiment, the RNAi agent is a multimer containing at least two duplexes represented by formula (III), (IIIa), (IIIb) or (IIIc), wherein the duplexes are connected by a linker. The linker can be cleavable or non-cleavable. Optionally, the multimer further comprise a ligand. Each of the duplexes can target the same gene or two different genes; or each of the duplexes can target same gene at two different target sites.

In one embodiment, the RNAi agent is a multimer containing three, four, five, six or more duplexes represented by formula (III), (IIIa), (IIIb) or (IIIc), wherein the duplexes are connected by a linker. The linker can be cleavable or non-cleavable. Optionally, the multimer further comprises a ligand. Each of the duplexes can target the same gene or two different genes; or each of the duplexes can target same gene at two different target sites.

In one embodiment, two RNAi agents represented by formula (III), (IIIa), (IIIb) or (IIIc) are linked to each other at the 5' end, and one or both of the 3' ends of the are optionally conjugated to a ligand. Each of the agents can target the same gene or two different genes; or each of the agents can target same gene at two different target sites.

Various publications describe multimeric RNAi agents. Such publications include WO2007/091269, U.S. Pat. No. 7,858,769, WO2010/141511, WO2007/117686, WO2009/014887 and WO2011/031520 the entire contents of which are hereby incorporated herein by reference.

The RNAi agent that contains conjugations of one or more carbohydrate moieties to a RNAi agent can optimize one or more properties of the RNAi agent. In many cases, the carbohydrate moiety will be attached to a modified subunit of the RNAi agent. For example, the ribose sugar of one or more ribonucleotide subunits of a dsRNA agent can be replaced with another moiety, e.g., a non-carbohydrate (preferably cyclic) carrier to which is attached a carbohydrate ligand. A ribonucleotide subunit in which the ribose sugar of the subunit has been so replaced is referred to herein as a ribose replacement modification subunit (RRMS). A cyclic carrier may be a carbocyclic ring system, i.e., all ring atoms are carbon atoms, or a heterocyclic ring system, i.e., one or more ring atoms may be a heteroatom, e.g., nitrogen, oxygen, sulfur. The cyclic carrier may be a monocyclic ring system, or may contain two or more rings, e.g. fused rings. The cyclic carrier may be a fully saturated ring system, or it may contain one or more double bonds.

The ligand may be attached to the polynucleotide via a carrier. The carriers include (i) at least one "backbone attachment point," preferably two "backbone attachment points" and (ii) at least one "tethering attachment point." A "backbone attachment point" as used herein refers to a functional group, e.g. a hydroxyl group, or generally, a bond available for, and that is suitable for incorporation of the carrier into the backbone, e.g., the phosphate, or modified phosphate, e.g., sulfur containing, backbone, of a ribonucleic acid. A "tethering attachment point" (TAP) in some embodiments refers to a constituent ring atom of the cyclic carrier, e.g., a carbon atom or a heteroatom (distinct from an atom which provides a backbone attachment point), that connects a selected moiety. The moiety can be, e.g., a carbohydrate, e.g. monosaccharide, disaccharide, trisaccharide, tetrasaccharide, oligosaccharide and polysaccharide. Optionally, the selected moiety is connected by an intervening tether to the cyclic carrier. Thus, the cyclic carrier will often include a functional group, e.g., an amino group, or generally, provide a bond, that is suitable for incorporation or tethering of another chemical entity, e.g., a ligand to the constituent ring.

The RNAi agents may be conjugated to a ligand via a carrier, wherein the carrier can be cyclic group or acyclic group; preferably, the cyclic group is selected from pyrrolidinyl, pyrazolinyl, pyrazolidinyl, imidazolinyl, imidazolidinyl, piperidinyl, piperazinyl, [1,3]dioxolane, oxazolidinyl, isoxazolidinyl, morpholinyl, thiazolidinyl, isothiazolidinyl, quinoxalinyl, pyridazinonyl, tetrahydrofuryl and decalin; preferably, the acyclic group is selected from serinol backbone or diethanolamine backbone.

In certain specific embodiments, the RNAi agent of the invention is an agent selected from the group of agents listed in Table 1 and consisting of D1000, D1001, D1002, D1003, D1004, D1005, D1006, D1007, D1008, D1009, D1010, D1011, D1012, D1013, D1014, D1015, D1016, D1017, D1018, D1019, D1020, D1021, D1022, D1023, D1024, D1025, D1026, D1027, D1028, D1029, D1030, D1031, D1032, D1033, D1034, D1035, D1036, D1037, D1038, D1039, D1040, D1041, D1042, D1043, D1044, D1045, D1046, D1047, D1048, D1049, D1050, D1051, D1052, D1053, D1054, D1055, D1056, D1057, D1058, D1059, D1060, D1061, D1062, D1063, D1064, D1065, D1066, D1067, D1068, D1069, D1070, D1071, D1072, D1073, D1074, D1075, D1076, D1077, D1078, D1079, D1080, D1081, D1082, D1083, D1084, D1085, D1086, D1087, D1088, D1089, D1090, D1091, D1092, D1093, D1094, D1095, D1096, D1097, D1098, D1099, D1100, D1101, D1102, D1103, D1104, D1105, D1106, D1107, D1108, D1109, D1110, D1111, D1112, D1113, D1114, D1115, D1116, D1117, D1118, D1119, D1120, D1121, D1122, D1123, D1124, D1125, D1126, D1127, D1128, D1129, D1130, D1131, D1132, D1133, D1134, D1135, D1136, D1137, D1138, D1139, D1140, D1141, D1142, D1143, D1144, D1145, D1146, D1147, D1148, D1149, D1150, D1151, D1152, D1153, D1154, D1155, D1156, D1157, D1158, D1159, D1160, D1161, D1162, D1163, D1164, D1165, D1166, D1167, D1168, D1169, D1170, D1171, D1172, D1173, D1174, D1175, D1176, D1177, D1178, D1179, D1180, D1181, D1182, D1183, D1184, D1185, D1186, D1187, D1188, D1189, D1190, D1191, D1192, D1193, D1194, D1195, D1196, D1197, D1198, D1199, D1200, D1201, D1202, D1203, D1204, D1205, D1206, D1207, D1208, D1209, D1210, D1211, D1212, D1213, D1214, D1215, D1216, D1217, D1218, D1219, D1220, D1221, D1222, D1223, D1224, D1225, D1226, D1227, D1228, D1229, D1230, D1231, D1232, D1233, D1234, D1235, D1236, D1237, D1238, D1239, D1240, D1241, D1242, D1243, D1244, D1245, D1246, D1247, D1248, D1249, D1250, D1251, D1252, D1253, D1254, D1255, D1256, D1257, D1258, D1259, D1260, D1261, D1262, D1263, D1264, D1265, D1266, D1267, D1268, D1269, D1270, D1271, D1272, D1273, D1274, D1275, D1276, D1277, D1278, D1279, D1280, D1281, D1282, D1283, D1284, D1285, D1286, D1287, D1288, D1289, D1290, D1291, D1292, D1293, D1294, D1295, D1296, D1297, D1298, D1299, D1300, D1301, D1302, D1303, D1304, D1305, D1306, D1307, D1308, D1309, D1310, D1311, D1312, D1313, D1314, D1315, D1316, D1317, D1318, D1319, D1320, D1321, D1322, D1323, D1324, D1325, D1326, D1327, D1328, D1329, D1330, D1331, D1332, D1333, D1334, D1335, D1336, D1337, D1338, D1339, D1340, D1341, D1342, D1343, D1344, D1345, D1346, D1347, D1348, D1349, D1350, D1351, D1352, D1353, D1354, D1355, D1356, D1357, D1358, D1359, D1360, D1361, D1362, D1363, D1364, D1365, D1366, D1367, D1368, D1369, D1370, D1371, D1372, D1373, D1374, D1375, D1376, D1377, D1378, D1379, D1380, D1381, D1382, D1383, D1384, D1385, D1386, D1387, D1388, D1389, D1390, D1391, D1392, D1393, D1394, D1395, D1396, D1397, D1398, D1399, D1400, D1401, D1402, D1403, D1404, D1405, D1406, D1407, D1408, D1409, D1410, D1411, D1412, D1413, D1414, D1415, D1416, D1417, D1418, D1419, D1420, D1421, D1422, D1423, D1424, D1425, D1426, D1427, D1428, D1429, D1430, D1431, D1432, D1433, D1434, D1435, D1436, D1437, D1438, D1439, D1440, D1441, D1442, D1443, D1444, D1445, D1446, D1447, D1448, D1449, D1450, D1451, D1452, D1453, D1454, D1455, D1456, D1457, D1458, D1459, D1460, D1461, D1462, D1463, D1464, D1465, D1466, D1467, D1468, D1469, D1470, D1471, D1472, D1473, D1474, D1475, D1476, D1477, D1478, D1479, D1480, D1481, D1482, D1483, D1484, D1485, D1486, D1487, D1488, D1489, D1490, D1491, D1492, D1493, D1494, D1495, D1496, D1497, D1498, D1499, D1500, D1501, D1502, D1503, D1504, D1505, D1506, D1507, D1508, D1509, D1510, D1511, D1512, D1513, D1514, D1515, D1516, D1517, D1518, D1519, D1520, D1521, D1522, D1523, D1524, D1525, D1526, D1527, D1528, D1529, D1530, D1531, D1532, D1533, D1534, D1535, D1536, D1537, D1538, D1539, D1540, D1541, D1542, D1543, D1544, D1545, D1546, D1547, D1548, D1549, D1550, D1551, D1552, D1553, D1554, D1555, D1556, D1557, D1558, D1559, D1560, D1561, D1562, D1563, D1564, D1565, D1566, D1567, D1568, D1569, D1570, D1571, D1572, D1573, D1574, D1575, D1576, D1577, D1578, D1579, D1580, D1581, D1582, D1583, D1584, D1585, D1586, D1587, D1588, D1589, D1590, D1591, D1592, D1593, D1594, D1595, D1596, D1597, D1598, D1599, D1600, D1601, D1602, D1603, D1604, D1605, D1606, D1607, D1608, D1609, D1610, D1611, D1612, D1613, D1614, D1615, D1616, D1617, D1618, D1619, D1620, D1621, D1622, D1623, D1624, D1625, D1626, D1627, D1628, D1629, D1630, D1631, D1632, D1633, D1634, D1635, D1636, D1637, D1638, D1639, D1640, D1641, D1642, D1643, D1644, D1645, D1646, D1647, D1648, D1649, D1650, D1651, D1652, D1653, D1654, D1655, D1656, D1657, D1658, D1659, D1660, D1661, D1662, D1663, D1664, D1665, D1666, D1667, D1668, D1669, D1670, D1671, D1672, D1673, D1674, D1675, D1676, D1677, D1678, D1679, D1680, D1681, D1682, D1683, D1684, D1685, D1686, D1687, D1688, D1689, D1690, D1691, D1692, D1693, D1694, D1695, D1696, D1697, D1698, D1699, D1700, D1701, D1702, D1703, D1704, D1705, D1706, D1707, D1708, D1709, D1710, D1711, D1712, D1713, D1714, D1715, D1716, D1717, D1718, D1719, D1720, D1721, D1722, D1723, D1724, D1725, D1726, D1727, D1728, D1729, D1730, D1731, D1732, D1733, D1734, D1735, D1736, D1737, D1738, D1739, D1740, D1741, D1742, D1743, D1744, D1745, D1746, D1747, D1748, D1749, D1750, D1751, D1752, D1753, D1754, D1755, D1756, D1757, D1758, D1759, D1760, D1761, D1762, D1763, D1764, D1765, D1766, D1767, D1768, D1769, D1770, D1771, D1772, D1773, D1774, D1775, D1776, D1777, D1778, D1779, D1780, D1781, D1782, D1783, D1784, D1785, D1786, D1787, D1788, D1789, D1790, D1791, D1792, D1793, D1794, D1795, D1796, D1797, D1798, D1799, D1800, D1801, D1802, D1803, D1804, D1805, D1806, D1807, D1808, D1809, D1810, D1811, D1812, D1813, D1814, D1815, D1816, D1817, D1818, D1819, D1820, D1821, D1822, D1823, D1824, D1825, D1826, D1827, D1828, D1829, D1830, D1831, D1832, D1833, D1834, D1835, D1836, D1837, D1838, D1839, D1840, D1841, D1842, D1843, D1844, D1845, D1846, D1847, D1848, D1849, D1850, D1851, D1852, D1853, D1854, D1855, D1856, D1857, D1858, D1859, D1860, D1861, D1862, D1863, D1864, D1865, D1866, D1867, D1868, D1869, D1870, D1871, D1872, D1873, D1874, D1875, D1876, D1877, D1878, D1879, D1880, D1881, D1882, D1883, D1884, D1885, D1886, D1887, D1888, D1889, D1890, D1891, D1892, D1893, D1894, D1895, D1896, D1897, D1898, D1899, D1900, D1901, D1902, D1903, D1904, D1905, D1906, D1907, D1908, D1909, D1910, D1911, D1912, D1913, D1914, D1915, D1916, D1917, D1918, D1919, D1920, D1921, D1922, D1923, D1924, D1925, D1926, D1927, D1928, D1929, D1930, D1931, D1932, D1933, D1934, D1935, D1936, D1937, D1938, D1939, D1940, D1941, D1942, D1943, D1944, D1945, D1946, D1947, D1948, D1949, D1950, D1951, D1952, D1953, D1954, D1955, D1956, D1957, D1958, D1959, D1960, D1961, D1962, D1963, D1964, D1965, D1966, D1967, D1968, D1969, D1970, D1971, D1972, D1973, D1974, D1975, D1976, D1977, D1978, D1979, D1980, D1981, D1982, D1983, D1984, D1985, D1986, D1987, D1988, D1989, D1990, D1991, D1992, D1993, D1994, D1995, D1996, D1997, D1998, D1999, D2000, D2001, D2002, D2003, D2004, D2005, D2006, D2007, D2008, D2009, D2010, D2011, D2012, D2013, D2014, D2015, D2016, D2017, D2018, D2019, D2020, D2021, D2022, D2023, D2024, D2025, D2026, D2027, D2028, D2029, D2030, D2031, D2032, D2033, D2034, D2035, D2036, D2037, D2038, D2039, D2040, D2041, D2042, D2043, D2044, D2045, D2046, D2047, D2048, D2049, D2050, D2051, D2052, D2053, D2054, D2055, D2056, D2057, D2058, D2059, D2060, D2061, D2062, D2063, D2064, D2065, D2066, D2067, D2068, D2069, D2070, D2071, D2072, D2073, D2074, D2075, D2076, D2077, D2078, D2079, D2080, D2081, D2082, D2083, D2084, D2085, D2086, D2087, D2088, D2089, D2090 and D2091.

These agents may further comprise a ligand, such as a GalNAc ligand.

Ligands

The RNAi agents of the invention, e.g., double stranded RNAi agents, may optionally be conjugated to one or more ligands. The ligand can be attached to the sense strand, antisense strand or both strands, at the 3'-end, 5'-end or both ends. For instance, the ligand may be conjugated to the sense strand. In preferred embodiments, the ligand is conjugated to the 3'-end of the sense strand. In one preferred embodiment, the ligand is a GalNAc ligand. In particularly preferred embodiments, the ligand is GalNAc$_3$:

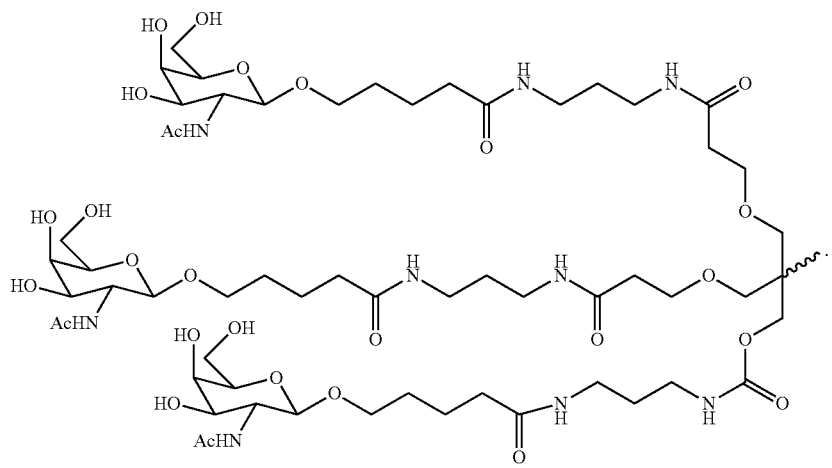 [SMILES: CC(=O)NC1C(OCCCCC(=O)NCCCNC(=O)CCOCC(C)(COCCC(=O)NCCCNC(=O)CCCCOC2OC(CO)C(O)C(O)C2NC(C)=O)COC(=O)NCCCNC(=O)CCCCOC2OC(CO)C(O)C(O)C2NC(C)=O)OC(CO)C(O)C1O]

A wide variety of entities can be coupled to the RNAi agents of the present invention. Preferred moieties are ligands, which are coupled, preferably covalently, either directly or indirectly via an intervening tether.

In preferred embodiments, a ligand alters the distribution, targeting or lifetime of the molecule into which it is incorporated. In preferred embodiments a ligand provides an enhanced affinity for a selected target, e.g., molecule, cell or cell type, compartment, receptor e.g., a cellular or organ compartment, tissue, organ or region of the body, as, e.g., compared to a species absent such a ligand. Ligands providing enhanced affinity for a selected target are also termed targeting ligands.

Some ligands can have endosomolytic properties. The endosomolytic ligands promote the lysis of the endosome and/or transport of the composition of the invention, or its components, from the endosome to the cytoplasm of the cell. The endosomolytic ligand may be a polyanionic peptide or peptidomimetic which shows pH-dependent membrane activity and fusogenicity. In one embodiment, the endosomolytic ligand assumes its active conformation at endosomal pH. The "active" conformation is that conformation in which the endosomolytic ligand promotes lysis of the endo some and/or transport of the composition of the invention, or its components, from the endosome to the cytoplasm of the cell. Exemplary endosomolytic ligands include the GALA peptide (Subbarao et al., Biochemistry, 1987, 26: 2964-2972), the EALA peptide (Vogel et al., J. Am. Chem. Soc., 1996, 118: 1581-1586), and their derivatives (Turk et al., Biochem. Biophys. Acta, 2002, 1559: 56-68). In one embodiment, the endosomolytic component may contain a chemical group (e.g., an amino acid) which will undergo a change in charge or protonation in response to a change in pH. The endosomolytic component may be linear or branched.

Ligands can improve transport, hybridization, and specificity properties and may also improve nuclease resistance of the resultant natural or modified oligoribonucleotide, or a polymeric molecule comprising any combination of monomers described herein and/or natural or modified ribonucleotides.

Ligands in general can include therapeutic modifiers, e.g., for enhancing uptake; diagnostic compounds or reporter groups e.g., for monitoring distribution; cross-linking agents; and nuclease-resistance conferring moieties. General examples include lipids, steroids, vitamins, sugars, proteins, peptides, polyamines, and peptide mimics.

Ligands can include a naturally occurring substance, such as a protein (e.g., human serum albumin (HSA), low-density lipoprotein (LDL), high-density lipoprotein (HDL), or globulin); a carbohydrate (e.g., a dextran, pullulan, chitin, chitosan, inulin, cyclodextrin or hyaluronic acid); or a lipid. The ligand may also be a recombinant or synthetic molecule, such as a synthetic polymer, e.g., a synthetic polyamino acid, an oligonucleotide (e.g., an aptamer). Examples of polyamino acids include polyamino acid is a polylysine (PLL), poly L-aspartic acid, poly L-glutamic acid, styrene-maleic acid anhydride copolymer, poly(L-lactide-co-glycolied) copolymer, divinyl ether-maleic anhydride copolymer, N-(2-hydroxypropyl) methacrylamide copolymer (HMPA), polyethylene glycol (PEG), polyvinyl alcohol (PVA), polyurethane, poly(2-ethylacryllic acid), N-isopropylacrylamide polymers, or polyphosphazine. Example of polyamines include: polyethylenimine, polylysine (PLL), spermine, spermidine, polyamine, pseudopeptide-polyamine, peptidomimetic polyamine, dendrimer polyamine, arginine, amidine, protamine, cationic lipid, cationic porphyrin, quaternary salt of a polyamine, or an alpha helical peptide.

Ligands can also include targeting groups, e.g., a cell or tissue targeting agent, e.g., a lectin, glycoprotein, lipid or protein, e.g., an antibody, that binds to a specified cell type such as a kidney cell. A targeting group can be a thyrotropin, melanotropin, lectin, glycoprotein, surfactant protein A, Mucin carbohydrate, multivalent lactose, multivalent galactose, N-acetyl-galactosamine, N-acetyl-gulucosamine multivalent mannose, multivalent fucose, glycosylated polyaminoacids, multivalent galactose, transferrin, bisphosphonate, polyglutamate, polyaspartate, a lipid, cholesterol, a steroid, bile acid, folate, vitamin B12, biotin, an RGD peptide, an RGD peptide mimetic or an aptamer.

Other examples of ligands include dyes, intercalating agents (e.g., acridines), cross-linkers (e.g., psoralene, mitomycin C), porphyrins (TPPC4, texaphyrin, Sapphyrin), polycyclic aromatic hydrocarbons (e.g., phenazine, dihydrophenazine), artificial endonucleases or a chelator (e.g., EDTA), lipophilic molecules, e.g., cholesterol, cholic acid, adamantane acetic acid, 1-pyrene butyric acid, dihydrotestosterone, 1,3-Bis-O(hexadecyl)glycerol, geranyloxyhexyl group, hexadecylglycerol, borneol, menthol, 1,3-propanediol, heptadecyl group, palmitic acid, myristic acid, O3-(oleoyl)lithocholic acid, O3-(oleoyl)cholenic acid, dimethoxytrityl, or phenoxazine) and peptide conjugates (e.g., antennapedia peptide, Tat peptide), alkylating agents, phosphate, amino, mercapto, PEG (e.g., PEG-40K), MPEG, [MPEG]$_2$, polyamino, alkyl, substituted alkyl, radiolabeled markers, enzymes, haptens (e.g., biotin), transport/absorption facilitators (e.g., aspirin, vitamin E, folic acid), synthetic ribonucleases (e.g., imidazole, bisimidazole, histamine, imidazole clusters, acridine-imidazole conjugates, Eu3+ complexes of tetraazamacrocycles), dinitrophenyl, HRP, or AP.

Ligands can be proteins, e.g., glycoproteins, or peptides, e.g., molecules having a specific affinity for a co-ligand, or antibodies e.g., an antibody, that binds to a specified cell type such as a cancer cell, endothelial cell, or bone cell. Ligands may also include hormones and hormone receptors. They can also include non-peptidic species, such as lipids, lectins, carbohydrates, vitamins, cofactors, multivalent lactose, multivalent galactose, N-acetyl-galactosamine, N-acetyl-gulucosamine multivalent mannose, multivalent fucose, or aptamers. The ligand can be, for example, a lipopolysaccharide, an activator of p38 MAP kinase, or an activator of NF-κB.

The ligand can be a substance, e.g., a drug, which can increase the uptake of the iRNA agent into the cell, for example, by disrupting the cell's cytoskeleton, e.g., by disrupting the cell's microtubules, microfilaments, and/or intermediate filaments. The drug can be, for example, taxon, vincristine, vinblastine, cytochalasin, nocodazole, japlakinolide, latrunculin A, phalloidin, swinholide A, indanocine, or myoservin.

The ligand can increase the uptake of the oligonucleotide into the cell by, for example, activating an inflammatory response. Exemplary ligands that would have such an effect include tumor necrosis factor alpha (TNFalpha), interleukin-1 beta, or gamma interferon.

In one aspect, the ligand is a lipid or lipid-based molecule. Such a lipid or lipid-based molecule preferably binds a serum protein, e.g., human serum albumin (HSA). An HSA binding ligand allows for distribution of the conjugate to a target tissue, e.g., a non-kidney target tissue of the body. For example, the target tissue can be the liver, including parenchymal cells of the liver. Other molecules that can bind HSA can also be used as ligands. For example, naproxen or aspirin can be used. A lipid or lipid-based ligand can (a) increase resistance to degradation of the conjugate, (b) increase targeting or transport into a target cell or cell membrane, and/or (c) can be used to adjust binding to a serum protein, e.g., HSA.

A lipid based ligand can be used to modulate, e.g., control the binding of the conjugate to a target tissue. For example, a lipid or lipid-based ligand that binds to HSA more strongly will be less likely to be targeted to the kidney and therefore less likely to be cleared from the body. A lipid or lipid-based ligand that binds to HSA less strongly can be used to target the conjugate to the kidney.

In a preferred embodiment, the lipid based ligand binds HSA. Preferably, it binds HSA with a sufficient affinity such that the conjugate will be preferably distributed to a non-kidney tissue. However, it is preferred that the affinity not be so strong that the HSA-ligand binding cannot be reversed.

In another preferred embodiment, the lipid based ligand binds HSA weakly or not at all, such that the conjugate will be preferably distributed to the kidney. Other moieties that target to kidney cells can also be used in place of or in addition to the lipid based ligand.

In another aspect, the ligand is a moiety, e.g., a vitamin, which is taken up by a target cell, e.g., a proliferating cell. These are particularly useful for treating disorders characterized by unwanted cell proliferation, e.g., of the malignant or non-malignant type, e.g., cancer cells. Exemplary vitamins include vitamin A, E, and K. Other exemplary vitamins include B vitamins, e.g., folic acid, B12, riboflavin, biotin, pyridoxal or other vitamins or nutrients taken up by cancer cells. Also included are HAS, low density lipoprotein (LDL) and high-density lipoprotein (HDL).

In another aspect, the ligand is a cell-permeation agent, preferably a helical cell-permeation agent. Preferably, the agent is amphipathic. An exemplary agent is a peptide such as tat or antennopedia. If the agent is a peptide, it can be modified, including a peptidylmimetic, invertomers, non-peptide or pseudo-peptide linkages, and use of D-amino acids. The helical agent is preferably an alpha-helical agent, which preferably has a lipophilic and a lipophobic phase.

The ligand can be a peptide or peptidomimetic. A peptidomimetic (also referred to herein as an oligopeptidomimetic) is a molecule capable of folding into a defined three-dimensional structure similar to a natural peptide. The peptide or peptidomimetic moiety can be about 5-50 amino acids long, e.g., about 5, 10, 15, 20, 25, 30, 35, 40, 45, or 50 amino acids long. A peptide or peptidomimetic can be, for example, a cell permeation peptide, cationic peptide, amphipathic peptide, or hydrophobic peptide (e.g., consisting primarily of Tyr, Trp or Phe). The peptide moiety can be a dendrimer peptide, constrained peptide or crosslinked peptide. In another alternative, the peptide moiety can include a hydrophobic membrane translocation sequence (MTS). An exemplary hydrophobic MTS-containing peptide is RFGF having the amino acid sequence AAVALLPAVLLALLAP (SEQ ID NO:4). An RFGF analogue (e.g., amino acid sequence AALLPVL-LAAP) (SEQ ID NO:5) containing a hydrophobic MTS can also be a targeting moiety. The peptide moiety can be a "delivery" peptide, which can carry large polar molecules including peptides, oligonucleotides, and protein across cell membranes. For example, sequences from the HIV Tat protein (GRKKRRQRRRPPQ) (SEQ ID NO:6) and the Drosophila Antennapedia protein (RQIKIWFQNRRMKWKK) (SEQ ID NO:7) have been found to be capable of functioning as delivery peptides. A peptide or peptidomimetic can be encoded by a random sequence of DNA, such as a peptide identified from a phage-display library, or one-bead-one-compound (OBOC) combinatorial library (Lam et al., *Nature*, 354:82-84, 1991). Preferably the peptide or peptidomimetic tethered to an iRNA agent via an incorporated monomer unit is a cell targeting peptide such as an arginine-glycine-aspartic acid (RGD)-peptide, or RGD mimic. A peptide moiety can range in length from about 5 amino acids to about 40 amino acids. The peptide moieties can have a structural modification, such as to increase stability or direct conformational properties. Any of the structural modifications described below can be utilized. An RGD peptide moiety can be used to target a tumor cell, such as an endothelial tumor cell or a breast cancer tumor cell (Zitzmann et al., *Cancer Res.*, 62:5139-43, 2002). An RGD peptide can facilitate targeting of an iRNA agent to tumors of a variety of other tissues, including the lung, kidney, spleen, or liver (Aoki et al., *Cancer Gene Therapy* 8:783-787, 2001). Preferably, the RGD peptide will facilitate targeting of an iRNA agent to the kidney. The RGD peptide can be linear or cyclic, and can be modified, e.g., glycosylated or methylated to facilitate targeting to specific tissues. For example, a glycosylated RGD peptide can deliver an iRNA agent to a tumor cell expressing $\alpha_v\beta_3$ (Haubner et al., *Jour. Nucl. Med.*, 42:326-336, 2001). Peptides that target markers enriched in proliferating cells can be used. For example, RGD containing peptides and peptidomimetics can target cancer cells, in particular cells that exhibit an integrin. Thus, one could use RGD peptides, cyclic peptides containing RGD, RGD peptides that include D-amino acids, as well as synthetic RGD mimics. In addition to RGD, one can use other moieties that target the integrin ligand. Generally, such ligands can be used to control proliferating cells and angiogeneis. Preferred conjugates of this type of ligand target PECAM-1, VEGF, or other cancer gene, e.g., a cancer gene described herein.

A "cell permeation peptide" is capable of permeating a cell, e.g., a microbial cell, such as a bacterial or fungal cell, or a mammalian cell, such as a human cell. A microbial cell-permeating peptide can be, for example, an α-helical linear peptide (e.g., LL-37 or Ceropin P1), a disulfide bond-containing peptide (e.g., α-defensin, β-defensin or bactenecin), or a peptide containing only one or two dominating amino acids (e.g., PR-39 or indolicidin). A cell permeation peptide can also include a nuclear localization signal (NLS). For example, a cell permeation peptide can be a bipartite amphipathic peptide, such as MPG, which is derived from the fusion peptide domain of HIV-1 gp41 and the NLS of SV40 large T antigen (Simeoni et al., Nucl. Acids Res. 31:2717-2724, 2003).

In one embodiment, a targeting peptide can be an amphipathic α-helical peptide. Exemplary amphipathic α-helical peptides include, but are not limited to, cecropins, lycotoxins, paradaxins, buforin, CPF, bombinin-like peptide (BLP), cathelicidins, ceratotoxins, S. clava peptides, hagfish intestinal antimicrobial peptides (HFIAPs), magainines, brevinins-2, dermaseptins, melittins, pleurocidin, $H_2A$ peptides, Xenopus peptides, esculentinis-1, and caerins. A number of factors will preferably be considered to maintain the integrity of helix stability. For example, a maximum number of helix stabilization residues will be utilized (e.g., leu, ala, or lys), and a minimum number helix destabilization residues will be utilized (e.g., proline, or cyclic monomeric units. The capping residue will be considered (for example Gly is an exemplary N-capping residue and/or C-terminal amidation can be used to provide an extra H-bond to stabilize the helix. Formation of salt bridges between residues with opposite charges, separated by i±3, or i±4 positions can provide stability. For example, cationic residues such as lysine, arginine, homoarginine, ornithine or histidine can form salt bridges with the anionic residues glutamate or aspartate.

Peptide and peptidomimetic ligands include those having naturally occurring or modified peptides, e.g., D or L peptides; α, β, or γ peptides; N-methyl peptides; azapeptides; peptides having one or more amide, i.e., peptide, linkages replaced with one or more urea, thiourea, carbamate, or sulfonyl urea linkages; or cyclic peptides.

The targeting ligand can be any ligand that is capable of targeting a specific receptor. Examples are: folate, GalNAc, galactose, mannose, mannose-6P, clusters of sugars such as GalNAc cluster, mannose cluster, galactose cluster, or an apatamer. A cluster is a combination of two or more sugar units. The targeting ligands also include integrin receptor ligands, Chemokine receptor ligands, transferrin, biotin, serotonin receptor ligands, PSMA, endothelin, GCPII, somatostatin, LDL and HDL ligands. The ligands can also be based on nucleic acid, e.g., an aptamer. The aptamer can be unmodified or have any combination of modifications disclosed herein.

Endosomal release agents include imidazoles, poly or oligoimidazoles, PEIs, peptides, fusogenic peptides, polycarboxylates, polyactions, masked oligo or poly cations or anions, acetals, polyacetals, ketals/polyketals, orthoesters, polymers with masked or unmasked cationic or anionic charges, dendrimers with masked or unmasked cationic or anionic charges.

PK modulator stands for pharmacokinetic modulator. PK modulators include lipophiles, bile acids, steroids, phospholipid analogues, peptides, protein binding agents, PEG, vitamins etc. Examplary PK modulators include, but are not limited to, cholesterol, fatty acids, cholic acid, lithocholic acid, dialkylglycerides, diacylglyceride, phospholipids, sphingolipids, naproxen, ibuprofen, vitamin E, biotin etc. Oligonucleotides that comprise a number of phosphorothioate linkages are also known to bind to serum protein, thus short oligonucleotides, e.g., oligonucleotides of about 5 bases, 10 bases, 15 bases or 20 bases, comprising multiple phosphorothioate linkages in the backbone are also amenable to the present invention as ligands (e.g., as PK modulating ligands).

In addition, aptamers that bind serum components (e.g., serum proteins) are also amenable to the present invention as PK modulating ligands.

Other ligand conjugates amenable to the invention are described in U.S. patent application Ser. No. 10/916,185, filed Aug. 10, 2004; U.S. Ser. No. 10/946,873, filed Sep. 21, 2004; U.S. Ser. No. 10/833,934, filed Aug. 3, 2007; U.S. Ser. No. 11/115,989 filed Apr. 27, 2005 and U.S. Ser. No. 11/944, 227 filed Nov. 21, 2007, which are incorporated by reference in their entireties for all purposes.

When two or more ligands are present, the ligands can all have same properties, all have different properties or some ligands have the same properties while others have different properties. For example, a ligand can have targeting properties, have endosomolytic activity or have PK modulating properties. In a preferred embodiment, all the ligands have different properties.

Ligands can be coupled to the oligonucleotides at various places, for example, 3'-end, 5'-end, and/or at an internal position. In preferred embodiments, the ligand is attached to the oligonucleotides via an intervening tether, e.g., a carrier described herein. The ligand or tethered ligand may be present on a monomer when the monomer is incorporated into the growing strand. In some embodiments, the ligand may be incorporated via coupling to a "precursor" monomer after the "precursor" monomer has been incorporated into the growing strand. For example, a monomer having, e.g., an amino-terminated tether (i.e., having no associated ligand), e.g., TAP-$(CH_2)_n NH_2$ may be incorporated into a growing oligonucleotide strand. In a subsequent operation, i.e., after incorporation of the precursor monomer into the strand, a ligand having an electrophilic group, e.g., a pentafluorophenyl ester or aldehyde group, can subsequently be attached to the precursor monomer by coupling the electrophilic group of the ligand with the terminal nucleophilic group of the precursor monomer's tether.

In another example, a monomer having a chemical group suitable for taking part in Click Chemistry reaction may be incorporated, e.g., an azide or alkyne terminated tether/linker. In a subsequent operation, i.e., after incorporation of the precursor monomer into the strand, a ligand having complementary chemical group, e.g. an alkyne or azide can be attached to the precursor monomer by coupling the alkyne and the azide together.

For double-stranded oligonucleotides, ligands can be attached to one or both strands. In some embodiments, a double-stranded iRNA agent contains a ligand conjugated to the sense strand. In other embodiments, a double-stranded iRNA agent contains a ligand conjugated to the antisense strand.

In some embodiments, ligand can be conjugated to nucleobases, sugar moieties, or internucleosidic linkages of nucleic acid molecules. Conjugation to purine nucleobases or derivatives thereof can occur at any position including, endocyclic and exocyclic atoms. In some embodiments, the 2-, 6-, 7-, or 8-positions of a purine nucleobase are attached to a conjugate moiety. Conjugation to pyrimidine nucleobases or derivatives thereof can also occur at any position. In some embodiments, the 2-, 5-, and 6-positions of a pyrimidine nucleobase can be substituted with a conjugate moiety. Conjugation to sugar moieties of nucleosides can occur at any carbon atom. Example carbon atoms of a sugar moiety that can be attached to a conjugate moiety include the 2', 3', and 5' carbon atoms. The 1' position can also be attached to a conjugate moiety, such as in an abasic residue. Internucleosidic linkages can also bear conjugate moieties. For phosphorus-containing linkages (e.g., phosphodiester, phosphorothioate, phosphorodithioate, phosphoroamidate, and the like), the conjugate moiety can be attached directly to the phosphorus atom or to an O, N, or S atom bound to the phosphorus atom. For amine- or amide-containing internucleosidic linkages (e.g., PNA), the conjugate moiety can be attached to the nitrogen atom of the amine or amide or to an adjacent carbon atom.

Any suitable ligand in the field of RNA interference may be used, although the ligand is typically a carbohydrate e.g. monosaccharide (such as GalNAc), disaccharide, trisaccharide, tetrasaccharide, polysaccharide.

Linkers that conjugate the ligand to the nucleic acid include those discussed above. For example, the ligand can be one or more GalNAc (N-acetylglucosamine) derivatives attached through a bivalent or trivalent branched linker.

In one embodiment, the dsRNA of the invention is conjugated to a bivalent and trivalent branched linkers include the structures shown in any of formula (IV)-(VII):

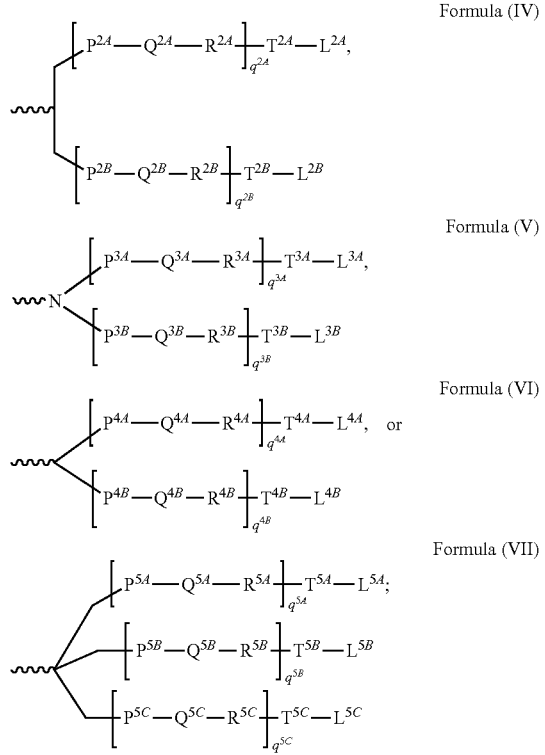

Formula (IV)

Formula (V)

Formula (VI)

Formula (VII)

wherein:

$q^{2A}$, $q^{2B}$, $q^{3A}$, $q^{3B}$, $q^{4A}$, $q^{4B}$, $q^{5A}$, $q^{5B}$ and $q^{5C}$ represent independently for each occurrence 0-20 and wherein the repeating unit can be the same or different; $P^{2A}$, $P^{2B}$, $P^{3A}$, $P^{3B}$, $P^{4A}$, $P^{4B}$, $P^{5A}$, $P^{5B}$, $P^{5C}$, $T^{2A}$, $T^{2B}$, $T^{3A}$, $T^{3B}$, $T^{4A}$, $T^{4B}$, $T^{4A}$, $T^{5B}$, $T^{5C}$ are each independently for each occurrence absent, CO, NH, O, S, OC(O), NHC(O), CH$_2$, CH$_2$NH or CH$_2$O;

$Q^{2A}$, $Q^{2B}$, $Q^{3A}$, $Q^{3B}$, $Q^{4A}$, $Q^{4B}$, $Q^{5A}$, $Q^{5B}$, $Q^{5C}$ are independently for each occurrence absent, alkylene, substituted alkylene wherein one or more methylenes can be interrupted or terminated by one or more of O, S, S(O), SO$_2$, N(R$^N$), C(R')=C(R"), C≡C or C(O);

$R^{2A}$, $R^{2B}$, $R^{3A}$, $R^{3B}$, $R^{4A}$, $R^{4B}$, $R^{5A}$, $R^{5B}$, $R^{5C}$ are each independently for each occurrence absent, NH, O, S, CH$_2$, C(O)O, C(O)NH, NHCH(R$^a$)C(O), —C(O)—CH(R$^a$)—NH—, CO, CH=N—O,

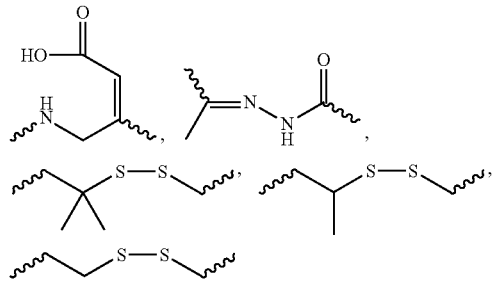

or heterocyclyl;

$L^{2A}$, $L^{2B}$, $L^{3A}$, $L^{3B}$, $L^{4A}$, $L^{4B}$, $L^{5A}$, $L^{5B}$ and $L^{5C}$ represent the ligand; i.e. each independently for each occurrence a monosaccharide (such as GalNAc), disaccharide, trisaccharide, tetrasaccharide, oligosaccharide, or polysaccharide; and R$^a$ is H or amino acid side chain.

Trivalent conjugating GalNAc derivatives are particularly useful for use with RNAi agents for inhibiting the expression of a target gene, such as those of formula (VII):

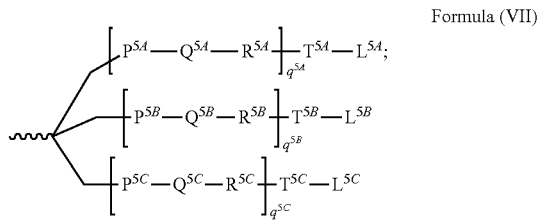

Formula (VII)

wherein $L^{5A}$, $L^{5B}$ and $L^{5C}$ represent a monosaccharide, such as GalNAc derivative.

Examples of suitable bivalent and trivalent branched linker groups conjugating GalNAc derivatives include, but are not limited to, the following compounds:

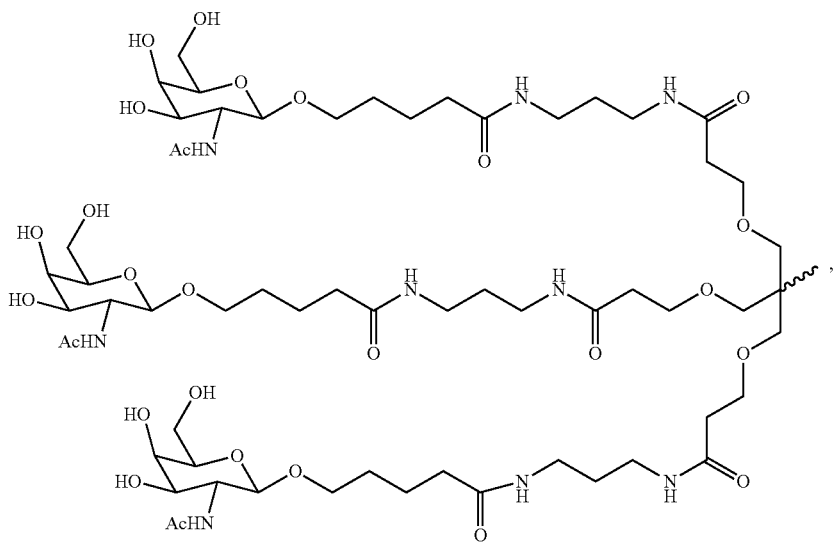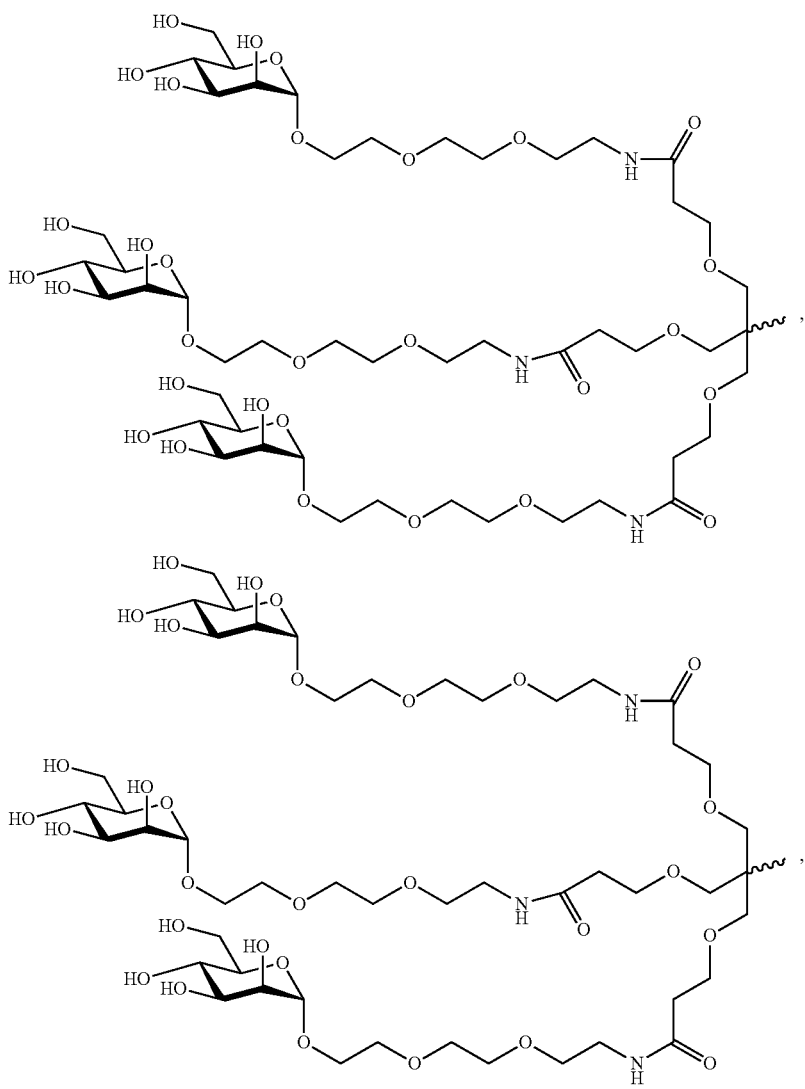

43 44
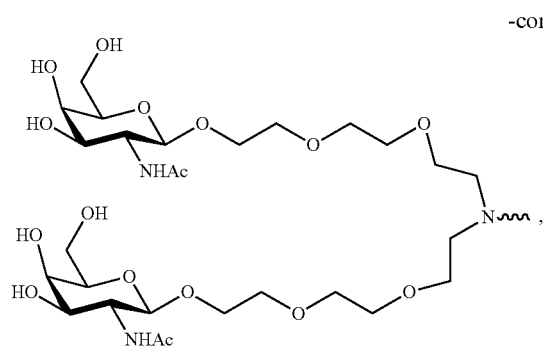
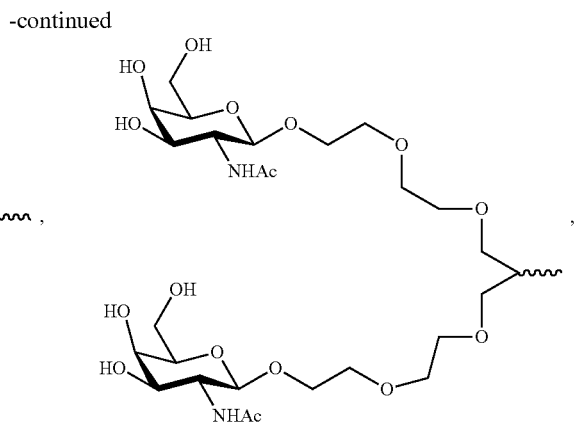
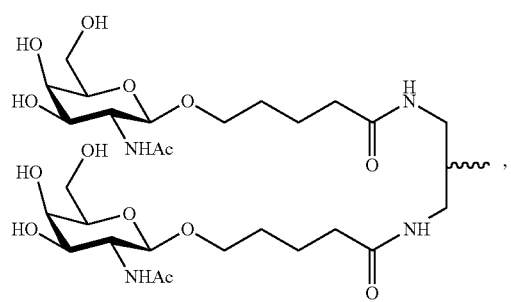
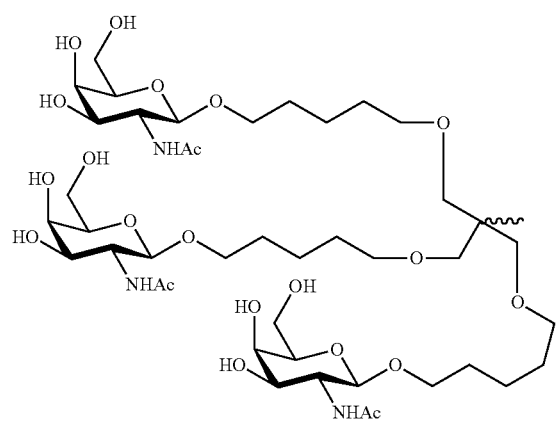
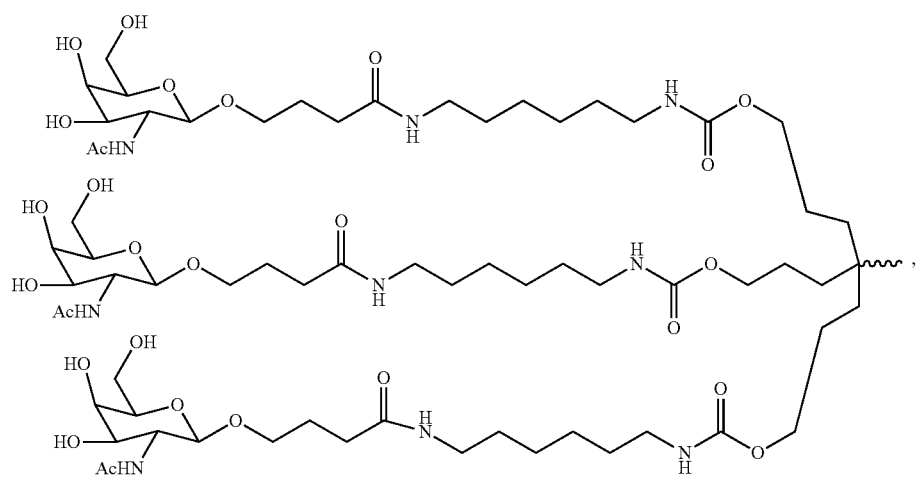

-continued

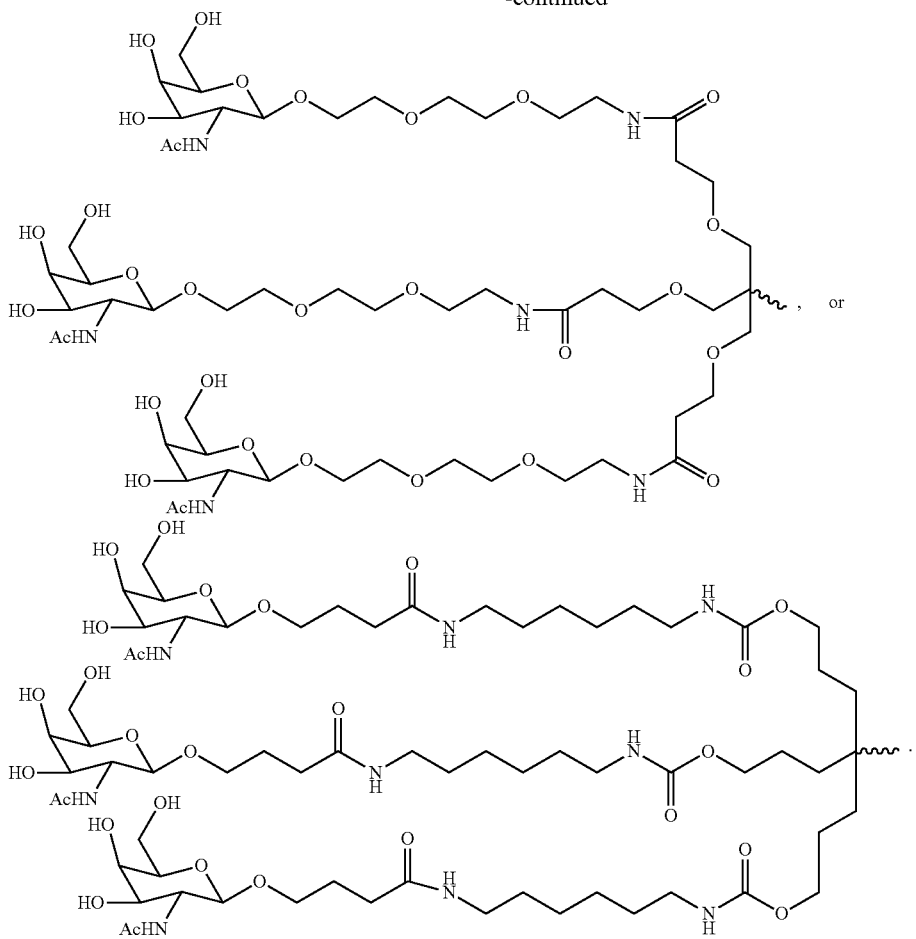

In other embodiments, the RNAi agent of the invention is an agent selected from the group consisting of AD-45163, AD-45165, AD-51544, AD-51545, AD-51546, and AD-51547.

III. Pharmaceutical Compositions

The RNAi agents of the invention may be formulated for administration in any convenient way for use in human or veterinary medicine, by analogy with other pharmaceuticals. The pharmaceutical compositions comprising RNAi agents of the invention may be, for example, solutions with or without a buffer, or compositions containing pharmaceutically acceptable carriers. Such compositions include, for example, aqueous or crystalline compositions, liposomal formulations, micellar formulations, emulsions, and gene therapy vectors.

In the methods of the invention, the RNAi agent may be administered in a solution. A free RNAi agent may be administered in an unbuffered solution, e.g., in saline or in water. Alternatively, the free siRNA may also be administered in a suitable buffer solution. The buffer solution may comprise acetate, citrate, prolamine, carbonate, or phosphate, or any combination thereof. In a preferred embodiment, the buffer solution is phosphate buffered saline (PBS). The pH and osmolarity of the buffer solution containing the RNAi agent can be adjusted such that it is suitable for administering to a subject.

In some embodiments, the buffer solution further comprises an agent for controlling the osmolarity of the solution, such that the osmolarity is kept at a desired value, e.g., at the physiologic values of the human plasma. Solutes which can be added to the buffer solution to control the osmolarity include, but are not limited to, proteins, peptides, amino acids, non-metabolized polymers, vitamins, ions, sugars, metabolites, organic acids, lipids, or salts. In some embodiments, the agent for controlling the osmolarity of the solution is a salt. In certain embodiments, the agent for controlling the osmolarity of the solution is sodium chloride or potassium chloride.

In other embodiments, the RNAi agent is formulated as a composition that includes one or more RNAi agents and a pharmaceutically acceptable carrier. As used herein the language "pharmaceutically acceptable carrier" is intended to include any and all solvents, dispersion media, coatings, antibacterial and antifungal agents, isotonic and absorption delaying agents, and the like, compatible with pharmaceutical administration. The use of such media and agents for pharmaceutically active substances is well known in the art. Except insofar as any conventional media or agent is incompatible with the active compound, use thereof in the compositions is contemplated. Supplementary active compounds can also be incorporated into the compositions.

In one embodiment, the RNAi agent preparation includes at least a second therapeutic agent (e.g., an agent other than an RNA or a DNA). For example, an RNAi agent composition for the treatment of a TTR-associated disease, e.g., a transthyretin-related hereditary amyloidosis (familial amyloid polyneuropathy, FAP), may include a known drug for the amelioration of FAP, e.g., Tafamidis (INN, or Fx-1006A or Vyndaqel).

A formulated RNAi agent composition can assume a variety of states. In some examples, the composition is at least partially crystalline, uniformly crystalline, and/or anhydrous (e.g., it contains less than 80, 50, 30, 20, or 10% of water). In another example, the RNAi agent is in an aqueous phase, e.g., in a solution that includes water.

The aqueous phase or the crystalline compositions can be incorporated into a delivery vehicle, e.g., a liposome (particularly for the aqueous phase) or a particle (e.g., a microparticle as can be appropriate for a crystalline composition). Generally, the RNAi agent composition is formulated in a manner that is compatible with the intended method of administration, as described herein. For example, in particular embodiments the composition is prepared by at least one of the following methods: spray drying, lyophilization, vacuum drying, evaporation, fluid bed drying, or a combination of these techniques; or sonication with a lipid, freeze-drying, condensation and other self-assembly.

An RNAi agent preparation can be formulated in combination with another agent, e.g., another therapeutic agent or an agent that stabilizes RNAi agent, e.g., a protein that complexes with the RNAi agent to form an iRNP. Still other agents include chelators, e.g., EDTA (e.g., to remove divalent cations such as $Mg^{2+}$), salts, RNAse inhibitors (e.g., a broad specificity RNAse inhibitor such as RNAsin) and so forth.

In one embodiment, the RNAi agent preparation includes another siRNA compound, e.g., a second RNAi agent that can mediate RNAi with respect to a second gene, or with respect to the same gene. Still other preparation can include at least 3, 5, ten, twenty, fifty, or a hundred or more different RNAi agent species. Such RNAi agents can mediate RNAi with respect to a similar number of different genes.

The iRNA agents of the invention may be formulated for pharmaceutical use. Pharmaceutically acceptable compositions comprise a therapeutically- or prophylactically effective amount of one or more of the dsRNA agents in any of the preceding embodiments, taken alone or formulated together with one or more pharmaceutically acceptable carriers (additives), excipient and/or diluents.

Methods of preparing pharmaceutical compositions of the invention include the step of bringing into association an RNAi agent of the present invention with the carrier and, optionally, one or more accessory ingredients. In general, the compositions are prepared by uniformly and intimately bringing into association an RNAi agent of the present invention with liquid carriers, or finely divided solid carriers, or both, and then, if necessary, shaping the product.

The pharmaceutical compositions may be specially formulated for administration in solid or liquid form, including those adapted for the following: (1) oral administration, for example, drenches (aqueous or non-aqueous solutions or suspensions), tablets, e.g., those targeted for buccal, sublingual, and systemic absorption, boluses, powders, granules, pastes for application to the tongue; (2) parenteral administration, for example, by subcutaneous, intramuscular, intravenous or epidural injection as, for example, a sterile solution or suspension, or sustained-release formulation; (3) topical application, for example, as a cream, ointment, or a controlled-release patch or spray applied to the skin; (4) intravaginally or intrarectally, for example, as a pessary, cream or foam; (5) sublingually; (6) ocularly; (7) transdermally; or (8) nasally. Delivery using subcutaneous or intravenous methods can be particularly advantageous.

The phrase "pharmaceutically acceptable" is employed herein to refer to those compounds, materials, compositions, and/or dosage forms which are, within the scope of sound medical judgment, suitable for use in contact with the tissues of human beings and animals without excessive toxicity, irritation, allergic response, or other problem or complication, commensurate with a reasonable benefit/risk ratio.

The phrase "pharmaceutically-acceptable carrier" as used herein means a pharmaceutically-acceptable material, composition or vehicle, such as a liquid or solid filler, diluent, excipient, manufacturing aid (e.g., lubricant, talc magnesium, calcium or zinc stearate, or steric acid), or solvent encapsulating material, involved in carrying or transporting the subject compound from one organ, or portion of the body, to another organ, or portion of the body. Each carrier must be "acceptable" in the sense of being compatible with the other ingredients of the composition and not injurious to the patient. Some examples of materials which can serve as pharmaceutically-acceptable carriers include: (1) sugars, such as lactose, glucose and sucrose; (2) starches, such as corn starch and potato starch; (3) cellulose, and its derivatives, such as sodium carboxymethyl cellulose, ethyl cellulose and cellulose acetate; (4) powdered tragacanth; (5) malt; (6) gelatin; (7) lubricating agents, such as magnesium state, sodium lauryl sulfate and talc; (8) excipients, such as cocoa butter and suppository waxes; (9) oils, such as peanut oil, cottonseed oil, safflower oil, sesame oil, olive oil, corn oil and soybean oil; (10) glycols, such as propylene glycol; (11) polyols, such as glycerin, sorbitol, mannitol and polyethylene glycol; (12) esters, such as ethyl oleate and ethyl laurate; (13) agar; (14) buffering agents, such as magnesium hydroxide and aluminum hydroxide; (15) alginic acid; (16) pyrogen-free water; (17) isotonic saline; (18) Ringer's solution; (19) ethyl alcohol; (20) pH buffered solutions; (21) polyesters, polycarbonates and/or polyanhydrides; (22) bulking agents, such as polypeptides and amino acids (23) serum component, such as serum albumin, HDL and LDL; and (22) other non-toxic compatible substances employed in pharmaceutical compositions.

The compositions may conveniently be presented in unit dosage form and may be prepared by any methods well known in the art of pharmacy. The amount of RNAi agent which can be combined with a carrier material to produce a single dosage form will vary depending upon the host being treated, and the particular mode of administration. The RNAi agent which can be combined with a carrier material to produce a single dosage form will generally be that amount of the RNAi agent which produces a desired effect, e.g., therapeutic or prophylactic effect. Generally, out of one hundred percent, this amount will range from about 0.1 percent to about ninety-nine percent of RNAi agent, preferably from about 5 percent to about 70 percent, most preferably from about 10 percent to about 30 percent.

In certain embodiments, a composition of the present invention comprises an excipient selected from the group consisting of cyclodextrins, celluloses, liposomes, micelle forming agents, e.g., bile acids, and polymeric carriers, e.g., polyesters and polyanhydrides; and an RNAi agent of the present invention. In certain embodiments, an aforementioned composition renders orally bioavailable an RNAi agent of the present invention.

In some cases, in order to prolong the effect of an RNAi agent, it is desirable to slow the absorption of the agent from subcutaneous or intramuscular injection. This may be accomplished by the use of a liquid suspension of crystalline or amorphous material having poor water solubility. The rate of absorption of the RNAi agent then depends upon its rate of dissolution which, in turn, may depend upon crystal size and crystalline form. Alternatively, delayed absorption of a parenterally-administered RNAi agent may be accomplished by dissolving or suspending the agent in an oil vehicle.

Liposomes

An RNAi agent of the invention can be formulated for delivery in a membranous molecular assembly, e.g., a liposome or a micelle. As used herein, the term "liposome" refers to a vesicle composed of amphiphilic lipids arranged in at least one bilayer, e.g., one bilayer or a plurality of bilayers. Liposomes include unilamellar and multilamellar vesicles that have a membrane formed from a lipophilic material and an aqueous interior. The aqueous portion contains the RNAi agent composition. The lipophilic material isolates the aqueous interior from an aqueous exterior, which typically does not include the RNAi agent composition, although in some examples, it may. Liposomes are useful for the transfer and delivery of active ingredients to the site of action. Because the liposomal membrane is structurally similar to biological membranes, when liposomes are applied to a tissue, the liposomal bilayer fuses with bilayer of the cellular membranes. As the merging of the liposome and cell progresses, the internal aqueous contents that include the RNAi agent are delivered into the cell where the RNAi agent can specifically bind to a target RNA and can mediate RNAi. In some cases the liposomes are also specifically targeted, e.g., to direct the RNAi agent to particular cell types.

A liposome containing an RNAi agent can be prepared by a variety of methods. In one example, the lipid component of a liposome is dissolved in a detergent so that micelles are formed with the lipid component. For example, the lipid component can be an amphipathic cationic lipid or lipid conjugate. The detergent can have a high critical micelle concentration and may be nonionic. Exemplary detergents include cholate, CHAPS, octylglucoside, deoxycholate, and lauroyl sarcosine. The RNAi agent preparation is then added to the micelles that include the lipid component. The cationic groups on the lipid interact with the RNAi agent and condense around the RNAi agent to form a liposome. After condensation, the detergent is removed, e.g., by dialysis, to yield a liposomal preparation of RNAi agent.

If necessary a carrier compound that assists in condensation can be added during the condensation reaction, e.g., by controlled addition. For example, the carrier compound can be a polymer other than a nucleic acid (e.g., spermine or spermidine). pH can also be adjusted to favor condensation.

Methods for producing stable polynucleotide delivery vehicles, which incorporate a polynucleotide/cationic lipid complex as structural components of the delivery vehicle, are further described in, e.g., WO 96/37194, the entire contents of which are incorporated herein by reference. Liposome formation can also include one or more aspects of exemplary methods described in Felgner, P. L. et al., *Proc. Natl. Acad. Sci.*, USA 8:7413-7417, 1987; U.S. Pat. No. 4,897,355; U.S. Pat. No. 5,171,678; Bangham, et al. *M. Mol. Biol.* 23:238, 1965; Olson, et al. *Biochim. Biophys. Acta* 557:9, 1979; Szoka, et al. *Proc. Natl. Acad. Sci.* 75: 4194, 1978; Mayhew, et al. *Biochim. Biophys. Acta* 775:169, 1984; Kim, et al. *Biochim. Biophys. Acta* 728:339, 1983; and Fukunaga, et al. *Endocrinol.* 115:757, 1984. Commonly used techniques for preparing lipid aggregates of appropriate size for use as delivery vehicles include sonication and freeze-thaw plus extrusion (see, e.g., Mayer, et al. *Biochim. Biophys. Acta* 858:161, 1986). Microfluidization can be used when consistently small (50 to 200 nm) and relatively uniform aggregates are desired (Mayhew, et al. *Biochim. Biophys. Acta* 775:169, 1984). These methods are readily adapted to packaging RNAi agent preparations into liposomes.

Liposomes that are pH-sensitive or negatively-charged entrap nucleic acid molecules rather than complex with them. Since both the nucleic acid molecules and the lipid are similarly charged, repulsion rather than complex formation occurs. Nevertheless, some nucleic acid molecules are entrapped within the aqueous interior of these liposomes. pH-sensitive liposomes have been used to deliver DNA encoding the thymidine kinase gene to cell monolayers in culture. Expression of the exogenous gene was detected in the target cells (Zhou et al., *Journal of Controlled Release*, 19, (1992) 269-274).

One major type of liposomal composition includes phospholipids other than naturally-derived phosphatidylcholine. Neutral liposome compositions, for example, can be formed from dimyristoyl phosphatidylcholine (DMPC) or dipalmitoyl phosphatidylcholine (DPPC). Anionic liposome compositions generally are formed from dimyristoyl phosphatidylglycerol, while anionic fusogenic liposomes are formed primarily from dioleoyl phosphatidylethanolamine (DOPE). Another type of liposomal composition is formed from phosphatidylcholine (PC) such as, for example, soybean PC, and egg PC. Another type is formed from mixtures of phospholipid and/or phosphatidylcholine and/or cholesterol.

Examples of other methods to introduce liposomes into cells in vitro and in vivo include U.S. Pat. No. 5,283,185; U.S. Pat. No. 5,171,678; WO 94/00569; WO 93/24640; WO 91/16024; Felgner, *J. Biol. Chem.* 269:2550, 1994; Nabel, *Proc. Natl. Acad. Sci.* 90:11307, 1993; Nabel, *Human Gene Ther.* 3:649, 1992; Gershon, *Biochem.* 32:7143, 1993; and Strauss *EMBO J.* 11:417, 1992.

In one embodiment, cationic liposomes are used. Cationic liposomes possess the advantage of being able to fuse to the cell membrane. Non-cationic liposomes, although not able to fuse as efficiently with the plasma membrane, are taken up by macrophages in vivo and can be used to deliver RNAi agents to macrophages.

Further advantages of liposomes include: liposomes obtained from natural phospholipids are biocompatible and biodegradable; liposomes can incorporate a wide range of water and lipid soluble drugs; liposomes can protect encapsulated RNAi agents in their internal compartments from metabolism and degradation (Rosoff, in "Pharmaceutical Dosage Forms," Lieberman, Rieger and Banker (Eds.), 1988, volume 1, p. 245). Important considerations in the preparation of liposome formulations are the lipid surface charge, vesicle size and the aqueous volume of the liposomes.

A positively charged synthetic cationic lipid, N-[1-(2,3-dioleyloxy)propyl]-N,N,N-trimethylammonium chloride (DOTMA) can be used to form small liposomes that interact spontaneously with nucleic acid to form lipid-nucleic acid complexes which are capable of fusing with the negatively charged lipids of the cell membranes of tissue culture cells, resulting in delivery of RNAi agent (see, e.g., Felgner, P. L. et al., Proc. Natl. Acad. Sci., USA 8:7413-7417, 1987 and U.S. Pat. No. 4,897,355 for a description of DOTMA and its use with DNA).

A DOTMA analogue, 1,2-bis(oleoyloxy)-3-(trimethylammonia)propane (DOTAP) can be used in combination with a phospholipid to form DNA-complexing vesicles. Lipofectin™ Bethesda Research Laboratories, Gaithersburg, Md.) is an effective agent for the delivery of highly anionic nucleic acids into living tissue culture cells that comprise positively charged DOTMA liposomes which interact spontaneously with negatively charged polynucleotides to form complexes.

When enough positively charged liposomes are used, the net charge on the resulting complexes is also positive. Positively charged complexes prepared in this way spontaneously attach to negatively charged cell surfaces, fuse with the plasma membrane, and efficiently deliver functional nucleic acids into, for example, tissue culture cells. Another commercially available cationic lipid, 1,2-bis(oleoyloxy)-3,3-(trimethylammonia)propane ("DOTAP") (Boehringer Mannheim, Indianapolis, Ind.) differs from DOTMA in that the oleoyl moieties are linked by ester, rather than ether linkages.

Other reported cationic lipid compounds include those that have been conjugated to a variety of moieties including, for example, carboxyspermine which has been conjugated to one of two types of lipids and includes compounds such as 5-carboxyspermylglycine dioctaoleoylamide ("DOGS") (Transfectam™, Promega, Madison, Wis.) and dipalmitoylphosphatidylethanolamine 5-carboxyspermylamide ("DPPES") (see, e.g., U.S. Pat. No. 5,171,678).

Another cationic lipid conjugate includes derivatization of the lipid with cholesterol ("DC-Choi") which has been formulated into liposomes in combination with DOPE (See, Gao, X. and Huang, L., Biochim. Biophys. Res. Commun. 179:280, 1991). Lipopolylysine, made by conjugating polylysine to DOPE, has been reported to be effective for transfection in the presence of serum (Zhou, X. et al., Biochim. Biophys. Acta 1065:8, 1991). For certain cell lines, these liposomes containing conjugated cationic lipids, are said to exhibit lower toxicity and provide more efficient transfection than the DOTMA-containing compositions. Other commercially available cationic lipid products include DMRIE and DMRIE-HP (Vical, La Jolla, Calif.) and Lipofectamine (DOSPA) (Life Technology, Inc., Gaithersburg, Md.). Other cationic lipids suitable for the delivery of oligonucleotides are described in WO 98/39359 and WO 96/37194.

Liposomal formulations are particularly suited for topical administration, liposomes present several advantages over other formulations. Such advantages include reduced side effects related to high systemic absorption of the administered drug, increased accumulation of the administered drug at the desired target, and the ability to administer RNAi agent into the skin. In some implementations, liposomes are used for delivering RNAi agent to epidermal cells and also to enhance the penetration of RNAi agent into dermal tissues, e.g., into skin. For example, the liposomes can be applied topically. Topical delivery of drugs formulated as liposomes to the skin has been documented (see, e.g., Weiner et al., *Journal of Drug Targeting*, 1992, vol. 2, 405-410 and du Plessis et al., *Antiviral Research*, 18, 1992, 259-265; Mannino, R. J. and Fould-Fogerite, S., Biotechniques 6:682-690, 1988; Itani, T. et al. Gene 56:267-276. 1987; Nicolau, C. et al. Meth. Enz. 149:157-176, 1987; Straubinger, R. M. and Papahadjopoulos, D. Meth. Enz. 101:512-527, 1983; Wang, C. Y. and Huang, L., Proc. Natl. Acad. Sci. USA 84:7851-7855, 1987).

Non-ionic liposomal systems have also been examined to determine their utility in the delivery of drugs to the skin, in particular systems comprising non-ionic surfactant and cholesterol. Non-ionic liposomal formulations comprising Novasome I (glyceryl dilaurate/cholesterol/polyoxyethylene-10-stearyl ether) and Novasome II (glyceryl distearate/cholesterol/polyoxyethylene-10-stearyl ether) were used to deliver a drug into the dermis of mouse skin. Such formulations with RNAi agent are useful for treating a dermatological disorder.

Liposomes that include RNAi agent can be made highly deformable. Such deformability can enable the liposomes to penetrate through pore that are smaller than the average radius of the liposome. For example, transfersomes are a type of deformable liposomes. Transferosomes can be made by adding surface edge activators, usually surfactants, to a standard liposomal composition. Transfersomes that include RNAi agent can be delivered, for example, subcutaneously by infection in order to deliver RNAi agent to keratinocytes in the skin. In order to cross intact mammalian skin, lipid vesicles must pass through a series of fine pores, each with a diameter less than 50 nm, under the influence of a suitable transdermal gradient. In addition, due to the lipid properties, these transferosomes can be self-optimizing (adaptive to the shape of pores, e.g., in the skin), self-repairing, and can frequently reach their targets without fragmenting, and often self-loading.

Other formulations amenable to the present invention are described in U.S. provisional application Ser. Nos. 61/018, 616, filed Jan. 2, 2008; 61/018,611, filed Jan. 2, 2008; 61/039, 748, filed Mar. 26, 2008; 61/047,087, filed Apr. 22, 2008 and 61/051,528, filed May 8, 2008. PCT application no PCT/US2007/080331, filed Oct. 3, 2007 also describes formulations that are amenable to the present invention.

Surfactants

Surfactants find wide application in formulations such as emulsions (including microemulsions) and liposomes (see above). RNAi agent (or a precursor, e.g., a larger dsRNA which can be processed into a siRNA, or a DNA which encodes a siRNA or precursor) compositions can include a surfactant. In one embodiment, the siRNA is formulated as an emulsion that includes a surfactant. The most common way of classifying and ranking the properties of the many different types of surfactants, both natural and synthetic, is by the use of the hydrophile/lipophile balance (HLB). The nature of the hydrophilic group provides the most useful means for categorizing the different surfactants used in formulations (Rieger, in "Pharmaceutical Dosage Forms," Marcel Dekker, Inc., New York, N.Y., 1988, p. 285).

If the surfactant molecule is not ionized, it is classified as a nonionic surfactant. Nonionic surfactants find wide application in pharmaceutical products and are usable over a wide range of pH values. In general their HLB values range from 2 to about 18 depending on their structure. Nonionic surfactants include nonionic esters such as ethylene glycol esters, propylene glycol esters, glyceryl esters, polyglyceryl esters, sorbitan esters, sucrose esters, and ethoxylated esters. Nonionic alkanolamides and ethers such as fatty alcohol ethoxylates, propoxylated alcohols, and ethoxylated/propoxylated block polymers are also included in this class. The polyoxyethylene surfactants are the most popular members of the nonionic surfactant class.

If the surfactant molecule carries a negative charge when it is dissolved or dispersed in water, the surfactant is classified as anionic. Anionic surfactants include carboxylates such as soaps, acyl lactylates, acyl amides of amino acids, esters of sulfuric acid such as alkyl sulfates and ethoxylated alkyl sulfates, sulfonates such as alkyl benzene sulfonates, acyl isethionates, acyl taurates and sulfosuccinates, and phosphates. The most important members of the anionic surfactant class are the alkyl sulfates and the soaps.

If the surfactant molecule carries a positive charge when it is dissolved or dispersed in water, the surfactant is classified as cationic. Cationic surfactants include quaternary ammonium salts and ethoxylated amines. The quaternary ammonium salts are the most used members of this class.

If the surfactant molecule has the ability to carry either a positive or negative charge, the surfactant is classified as amphoteric. Amphoteric surfactants include acrylic acid derivatives, substituted alkylamides, N-alkylbetaines and phosphatides.

The use of surfactants in drug products, formulations and in emulsions has been reviewed (Rieger, in "Pharmaceutical Dosage Forms," Marcel Dekker, Inc., New York, N.Y., 1988, p. 285).

Micelles and Other Membranous Formulations

The RNAi agents of the invention can also be provided as micellar formulations. "Micelles" are defined herein as a particular type of molecular assembly in which amphipathic molecules are arranged in a spherical structure such that all the hydrophobic portions of the molecules are directed inward, leaving the hydrophilic portions in contact with the surrounding aqueous phase. The converse arrangement exists if the environment is hydrophobic.

A mixed micellar formulation suitable for delivery through transdermal membranes may be prepared by mixing an aqueous solution of the siRNA composition, an alkali metal $C_8$ to $C_{22}$ alkyl sulphate, and a micelle forming compound. Exemplary micelle forming compounds include lecithin, hyaluronic acid, pharmaceutically acceptable salts of hyaluronic acid, glycolic acid, lactic acid, chamomile extract, cucumber extract, oleic acid, linoleic acid, linolenic acid, monoolein, monooleates, monolaurates, borage oil, evening of primrose oil, menthol, trihydroxy oxo cholanyl glycine and pharmaceutically acceptable salts thereof, glycerin, polyglycerin, lysine, polylysine, triolein, polyoxyethylene ethers and analogues thereof, polidocanol alkyl ethers and analogues thereof, chenodeoxycholate, deoxycholate, and mixtures thereof. The micelle forming compounds may be added at the same time or after addition of the alkali metal alkyl sulphate. Mixed micelles will form with substantially any kind of mixing of the ingredients but vigorous mixing in order to provide smaller size micelles.

In one method a first micellar composition is prepared which contains the siRNA composition and at least the alkali metal alkyl sulphate. The first micellar composition is then mixed with at least three micelle forming compounds to form a mixed micellar composition. In another method, the micellar composition is prepared by mixing the siRNA composition, the alkali metal alkyl sulphate and at least one of the micelle forming compounds, followed by addition of the remaining micelle forming compounds, with vigorous mixing.

Phenol and/or m-cresol may be added to the mixed micellar composition to stabilize the formulation and protect against bacterial growth. Alternatively, phenol and/or m-cresol may be added with the micelle forming ingredients. An isotonic agent such as glycerin may also be added after formation of the mixed micellar composition.

For delivery of the micellar formulation as a spray, the formulation can be put into an aerosol dispenser and the dispenser is charged with a propellant. The propellant, which is under pressure, is in liquid form in the dispenser. The ratios of the ingredients are adjusted so that the aqueous and propellant phases become one, i.e., there is one phase. If there are two phases, it is necessary to shake the dispenser prior to dispensing a portion of the contents, e.g., through a metered valve. The dispensed dose of pharmaceutical agent is propelled from the metered valve in a fine spray.

Propellants may include hydrogen-containing chlorofluorocarbons, hydrogen-containing fluorocarbons, dimethyl ether and diethyl ether. In certain embodiments, HFA 134a (1,1,1,2 tetrafluoroethane) may be used.

The specific concentrations of the essential ingredients can be determined by relatively straightforward experimentation.

For absorption through the oral cavities, it is often desirable to increase, e.g., at least double or triple, the dosage for through injection or administration through the gastrointestinal tract.

Particles

In another embodiment, an RNAi agent of the invention may be incorporated into a particle, e.g., a microparticle. Microparticles can be produced by spray-drying, but may also be produced by other methods including lyophilization, evaporation, fluid bed drying, vacuum drying, or a combination of these techniques.

IV. Methods for Inhibiting TTR Expression

The present invention also provides methods of inhibiting expression of a transthyretin (TTR) in a cell. The methods include contacting a cell with an RNAi agent, e.g., double stranded RNAi agent, in an amount effective to inhibit expression of TTR in the cell, thereby inhibiting expression of TTR in the cell.

Contacting of a cell with an RNAi agent, e.g., a double stranded RNAi agent, may be done in vitro or in vivo. Contacting a cell in vivo with the RNAi agent includes contacting a cell or group of cells within a subject, e.g., a human subject, with the RNAi agent. Combinations of in vitro and in vivo methods of contacting a cell are also possible. Contacting a cell may be direct or indirect, as discussed above. Furthermore, contacting a cell may be accomplished via a targeting ligand, including any ligand described herein or known in the art. In preferred embodiments, the targeting ligand is a carbohydrate moiety, e.g., a GalNAc$_3$ ligand, or any other ligand that directs the RNAi agent to a site of interest, e.g., the liver of a subject.

The term "inhibiting," as used herein, is used interchangeably with "reducing," "silencing," "downregulating", "suppressing", and other similar terms, and includes any level of inhibition.

The phrase "inhibiting expression of a TTR" is intended to refer to inhibition of expression of any TTR gene (such as, e.g., a mouse TTR gene, a rat TTR gene, a monkey TTR gene, or a human TTR gene) as well as variants or mutants of a TTR gene. Thus, the TTR gene may be a wild-type TTR gene, a mutant TTR gene (such as a mutant TTR gene giving rise to amyloid deposition), or a transgenic TTR gene in the context of a genetically manipulated cell, group of cells, or organism.

"Inhibiting expression of a TTR gene" includes any level of inhibition of a TTR gene, e.g., at least partial suppression of the expression of a TTR gene. The expression of the TTR gene may be assessed based on the level, or the change in the level, of any variable associated with TTR gene expression, e.g., TTR mRNA level, TTR protein level, or the number or extent of amyloid deposits. This level may be assessed in an individual cell or in a group of cells, including, for example, a sample derived from a subject.

Inhibition may be assessed by a decrease in an absolute or relative level of one or more variables that are associated with TTR expression compared with a control level. The control level may be any type of control level that is utilized in the art, e.g., a pre-dose baseline level, or a level determined from a similar subject, cell, or sample that is untreated or treated with a control (such as, e.g., buffer only control or inactive agent control).

In some embodiments of the methods of the invention, expression of a TTR gene is inhibited by at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99%.

Inhibition of the expression of a TTR gene may be manifested by a reduction of the amount of mRNA expressed by a first cell or group of cells (such cells may be present, for example, in a sample derived from a subject) in which a TTR gene is transcribed and which has or have been treated (e.g., by contacting the cell or cells with an RNAi agent of the invention, or by administering an RNAi agent of the invention to a subject in which the cells are or were present) such that the expression of a TTR gene is inhibited, as compared to a second cell or group of cells substantially identical to the first cell or group of cells but which has not or have not been so treated (control cell(s)). In preferred embodiments, the inhibition is assessed by expressing the level of mRNA in treated cells as a percentage of the level of mRNA in control cells, using the following formula:

$$\frac{(mRNA \text{ in control cells}) - (mRNA \text{ in treated cells})}{(mRNA \text{ in control cells})} \cdot 100\%$$

Alternatively, inhibition of the expression of a TTR gene may be assessed in terms of a reduction of a parameter that is functionally linked to TTR gene expression, e.g., TTR protein expression, retinol binding protein level, vitamin A level, or presence of amyloid deposits comprising TTR. TTR gene silencing may be determined in any cell expressing TTR, either constitutively or by genomic engineering, and by any assay known in the art. The liver is the major site of TTR expression. Other significant sites of expression include the choroid plexus, retina and pancreas.

Inhibition of the expression of a TTR protein may be manifested by a reduction in the level of the TTR protein that is expressed by a cell or group of cells (e.g., the level of protein expressed in a sample derived from a subject). As explained above for the assessment of mRNA suppression, the inhibition of protein expression levels in a treated cell or group of cells may similarly be expressed as a percentage of the level of protein in a control cell or group of cells.

A control cell or group of cells that may be used to assess the inhibition of the expression of a TTR gene includes a cell or group of cells that has not yet been contacted with an RNAi agent of the invention. For example, the control cell or group of cells may be derived from an individual subject (e.g., a human or animal subject) prior to treatment of the subject with an RNAi agent.

The level of TTR mRNA that is expressed by a cell or group of cells, or the level of circulating TTR mRNA, may be determined using any method known in the art for assessing mRNA expression. In one embodiment, the level of expression of TTR in a sample is determined by detecting a transcribed polynucleotide, or portion thereof, e.g., mRNA of the TTR gene. RNA may be extracted from cells using RNA extraction techniques including, for example, using acid phenol/guanidine isothiocyanate extraction (RNAzol B; Biogenesis), RNeasy RNA preparation kits (Qiagen) or PAXgene (PreAnalytix, Switzerland). Typical assay formats utilizing ribonucleic acid hybridization include nuclear run-on assays, RT-PCR, RNase protection assays (Melton et al., *Nuc. Acids Res.* 12:7035), Northern blotting, in situ hybridization, and microarray analysis. Circulating TTR mRNA may be detected using methods the described in PCT/US2012/043584, the entire contents of which are hereby incorporated herein by reference.

In one embodiment, the level of expression of TTR is determined using a nucleic acid probe. The term "probe", as used herein, refers to any molecule that is capable of selectively binding to a specific TTR. Probes can be synthesized by one of skill in the art, or derived from appropriate biological preparations. Probes may be specifically designed to be labeled. Examples of molecules that can be utilized as probes include, but are not limited to, RNA, DNA, proteins, antibodies, and organic molecules.

Isolated mRNA can be used in hybridization or amplification assays that include, but are not limited to, Southern or Northern analyses, polymerase chain reaction (PCR) analyses and probe arrays. One method for the determination of mRNA levels involves contacting the isolated mRNA with a nucleic acid molecule (probe) that can hybridize to TTR mRNA. In one embodiment, the mRNA is immobilized on a solid surface and contacted with a probe, for example by running the isolated mRNA on an agarose gel and transferring the mRNA from the gel to a membrane, such as nitrocellulose. In an alternative embodiment, the probe(s) are immobilized on a solid surface and the mRNA is contacted with the probe(s), for example, in an Affymetrix gene chip array. A skilled artisan can readily adapt known mRNA detection methods for use in determining the level of TTR mRNA.

An alternative method for determining the level of expression of TTR in a sample involves the process of nucleic acid amplification and/or reverse transcriptase (to prepare cDNA) of for example mRNA in the sample, e.g., by RT-PCR (the experimental embodiment set forth in Mullis, 1987, U.S. Pat. No. 4,683,202), ligase chain reaction (Barany (1991) *Proc. Natl. Acad. Sci. USA* 88:189-193), self sustained sequence replication (Guatelli et al. (1990) *Proc. Natl. Acad. Sci. USA* 87:1874-1878), transcriptional amplification system (Kwoh et al. (1989) *Proc. Natl. Acad. Sci. USA* 86:1173-1177), Q-Beta Replicase (Lizardi et al. (1988) *Bio/Technology* 6:1197), rolling circle replication (Lizardi et al., U.S. Pat. No. 5,854,033) or any other nucleic acid amplification method, followed by the detection of the amplified molecules using techniques well known to those of skill in the art. These detection schemes are especially useful for the detection of nucleic acid molecules if such molecules are present in very low numbers. In particular aspects of the invention, the level of expression of TTR is determined by quantitative fluorogenic RT-PCR (i.e., the TaqMan™ System).

The expression levels of TTR mRNA may be monitored using a membrane blot (such as used in hybridization analysis such as Northern, Southern, dot, and the like), or microwells, sample tubes, gels, beads or fibers (or any solid support comprising bound nucleic acids). See U.S. Pat. Nos. 5,770,722, 5,874,219, 5,744,305, 5,677,195 and 5,445,934, which are incorporated herein by reference. The determination of TTR expression level may also comprise using nucleic acid probes in solution.

In preferred embodiments, the level of mRNA expression is assessed using branched DNA (bDNA) assays or real time PCR (qPCR). The use of these methods is described and exemplified in the Examples presented herein.

The level of TTR protein expression may be determined using any method known in the art for the measurement of protein levels. Such methods include, for example, electrophoresis, capillary electrophoresis, high performance liquid chromatography (HPLC), thin layer chromatography (TLC), hyperdiffusion chromatography, fluid or gel precipitin reactions, absorption spectroscopy, a colorimetric assays, spectrophotometric assays, flow cytometry, immunodiffusion (single or double), immunoelectrophoresis, Western blotting, radioimmunoassay (RIA), enzyme-linked immunosorbent assays (ELISAs), immunofluorescent assays, electrochemiluminescence assays, and the like.

In some embodiments, the efficacy of the methods of the invention can be monitored by detecting or monitoring a reduction in an amyloid TTR deposit. Reducing an amyloid TTR deposit, as used herein, includes any decrease in the size, number, or severity of TTR deposits, or to a prevention or reduction in the formation of TTR deposits, within an organ or area of a subject, as may be assessed in vitro or in vivo using any method known in the art. For example, some methods of assessing amyloid deposits are described in Gertz, M. A. & Rajukumar, S. V. (Editors) (2010), *Amyloidosis: Diagnosis and Treatment*, New York: Humana Press. Methods of assessing amyloid deposits may include biochemical analyses, as well as visual or computerized assessment of amyloid deposits, as made visible, e.g., using immunohistochemical staining, fluorescent labeling, light microscopy, electron microscopy, fluorescence microscopy, or other types of microscopy. Invasive or noninvasive imaging modalities, including, e.g., CT, PET, or NMR/MRI imaging may be employed to assess amyloid deposits.

The methods of the invention may reduce TTR deposits in any number of tissues or regions of the body including but not limited to the heart, liver, spleen, esophagus, stomach, intestine (ileum, duodenum and colon), brain, sciatic nerve, dorsal root ganglion, kidney and retina.

The term "sample" as used herein refers to a collection of similar fluids, cells, or tissues isolated from a subject, as well as fluids, cells, or tissues present within a subject. Examples of biological fluids include blood, serum and serosal fluids, plasma, lymph, urine, cerebrospinal fluid, saliva, ocular fluids, and the like. Tissue samples may include samples from tissues, organs or localized regions. For example, samples may be derived from particular organs, parts of organs, or fluids or cells within those organics. In certain embodiments, samples may be derived from the liver (e.g., whole liver or certain segments of liver or certain types of cells in the liver, such as, e.g., hepatocytes), the retina or parts of the retina (e.g., retinal pigment epithelium), the central nervous system or parts of the central nervous system (e.g., ventricles or choroid plexus), or the pancreas or certain cells or parts of the pancreas. In preferred embodiments, a "sample derived from a subject" refers to blood or plasma drawn from the subject. In further embodiments, a "sample derived from a subject" refers to liver tissue or retinal tissue derived from the subject.

In some embodiments of the methods of the invention, the RNAi agent is administered to a subject such that the RNAi agent is delivered to a specific site within the subject. The inhibition of expression of TTR may be assessed using measurements of the level or change in the level of TTR mRNA or TTR protein in a sample derived from fluid or tissue from the specific site within the subject. In preferred embodiments, the site is selected from the group consisting of liver, choroid plexus, retina, and pancreas. The site may also be a subsection or subgroup of cells from any one of the aforementioned sites (e.g., hepatocytes or retinal pigment epithelium). The site may also include cells that express a particular type of receptor (e.g., hepatocytes that express the asialogycloprotein receptor).

V. Methods for Treating or Preventing a TTR-Associated Disease

The present invention also provides methods for treating or preventing a TTR-associated disease in a subject. The methods include administering to the subject a therapeutically effective amount or prophylactically effective amount of an RNAi agent of the invention.

As used herein, a "subject" includes either a human or a non-human animal, preferably a vertebrate, and more preferably a mammal. A subject may include a transgenic organism. Most preferably, the subject is a human, such as a human suffering from or predisposed to developing a TTR-associated disease.

In some embodiments, the subject is suffering from a TTR-associated disease. In other embodiments, the subject is a subject at risk for developing a TTR-associated disease, e.g., a subject with a TTR gene mutation that is associated with the development of a TTR associated disease, a subject with a family history of TTR-associated disease, or a subject who has signs or symptoms suggesting the development of TTR amyloidosis.

A "TTR-associated disease," as used herein, includes any disease caused by or associated with the formation of amyloid deposits in which the fibril precursors consist of variant or wild-type TTR protein. Mutant and wild-type TTR give rise to various forms of amyloid deposition (amyloidosis). Amyloidosis involves the formation and aggregation of misfolded proteins, resulting in extracellular deposits that impair organ function. Clinical syndromes associated with TTR aggregation include, for example, senile systemic amyloidosis (SSA); systemic familial amyloidosis; familial amyloidotic polyneuropathy (FAP); familial amyloidotic cardiomyopathy (FAC); and leptomeningeal amyloidosis, also known as leptomeningeal or meningocerebrovascular amyloidosis, central nervous system (CNS) amyloidosis, or amyloidosis VII form.

In some embodiments of the methods of the invention, RNAi agents of the invention are administered to subjects suffering from familial amyloidotic cardiomyopathy (FAC) and senile systemic amyloidosis (SSA). Normal-sequence TTR causes cardiac amyloidosis in people who are elderly and is termed senile systemic amyloidosis (SSA) (also called senile cardiac amyloidosis (SCA) or cardiac amyloidosis). SSA often is accompanied by microscopic deposits in many other organs. TTR mutations accelerate the process of TTR amyloid formation and are the most important risk factor for the development of clinically significant TTR amyloidosis (also called ATTR (amyloidosis-transthyretin type)). More than 85 amyloidogenic TTR variants are known to cause systemic familial amyloidosis.

In some embodiments of the methods of the invention, RNAi agents of the invention are administered to subjects suffering from transthyretin (TTR)-related familial amyloidotic polyneuropathy (FAP). Such subjects may suffer from ocular manifestations, such as vitreous opacity and glaucoma. It is known to one of skill in the art that amyloidogenic transthyretin (ATTR) synthesized by retinal pigment epithelium (RPE) plays important roles in the progression of ocular amyloidosis. Previous studies have shown that panretinal laser photocoagulation, which reduced the RPE cells, prevented the progression of amyloid deposition in the vitreous, indicating that the effective suppression of ATTR expression in RPE may become a novel therapy for ocular amyloidosis (see, e.g., Kawaji, T., et al., Ophthalmology. (2010) 117: 552-555). The methods of the invention are useful for treatment of ocular manifestations of TTR related FAP, e.g., ocular amyloidosis. The RNAi agent can be delivered in a manner suitable for targeting a particular tissue, such as the eye. Modes of ocular delivery include retrobulbar, subcutaneous eyelid, subconjunctival, subtenon, anterior chamber or intravitreous injection (or internal injection or infusion). Specific formulations for ocular delivery include eye drops or ointments.

Another TTR-associated disease is hyperthyroxinemia, also known as "dystransthyretinemic hyperthyroxinemia" or "dysprealbuminemic hyperthyroxinemia". This type of hyperthyroxinemia may be secondary to an increased association of thyroxine with TTR due to a mutant TTR molecule with increased affinity for thyroxine. See, e.g., Moses et al. (1982) *J. Clin. Invest.*, 86, 2025-2033.

The RNAi agents of the invention may be administered to a subject using any mode of administration known in the art, including, but not limited to subcutaneous, intravenous, intramuscular, intraocular, intrabronchial, intrapleural, intraperitoneal, intraarterial, lymphatic, cerebrospinal, and any combinations thereof. In preferred embodiments, the agents are administered subcutaneously.

In some embodiments, the administration is via a depot injection. A depot injection may release the RNAi agent in a consistent way over a prolonged time period. Thus, a depot injection may reduce the frequency of dosing needed to obtain a desired effect, e.g., a desired inhibition of TTR, or a therapeutic or prophylactic effect. A depot injection may also provide more consistent serum concentrations. Depot injections may include subcutaneous injections or intramuscular injections. In preferred embodiments, the depot injection is a subcutaneous injection.

In some embodiments, the administration is via a pump. The pump may be an external pump or a surgically implanted pump. In certain embodiments, the pump is a subcutaneously implanted osmotic pump. In other embodiments, the pump is an infusion pump. An infusion pump may be used for intravenous, subcutaneous, arterial, or epidural infusions. In preferred embodiments, the infusion pump is a subcutaneous infusion pump. In other embodiments, the pump is a surgically implanted pump that delivers the RNAi agent to the liver.

Other modes of administration include epidural, intracerebral, intracerebroventricular, nasal administration, intraarterial, intracardiac, intraosseous infusion, intrathecal, and intravitreal, and pulmonary. The mode of administration may be chosen based upon whether local or systemic treatment is desired and based upon the area to be treated. The route and site of administration may be chosen to enhance targeting.

In some embodiments, the RNAi agent is administered to a subject in an amount effective to inhibit TTR expression in a cell within the subject. The amount effective to inhibit TTR expression in a cell within a subject may be assessed using methods discussed above, including methods that involve assessment of the inhibition of TTR mRNA, TTR protein, or related variables, such as amyloid deposits.

In some embodiments, the RNAi agent is administered to a subject in a therapeutically or prophylactically effective amount.

"Therapeutically effective amount," as used herein, is intended to include the amount of an RNAi agent that, when administered to a patient for treating a TTR associated disease, is sufficient to effect treatment of the disease (e.g., by diminishing, ameliorating or maintaining the existing disease or one or more symptoms of disease). The "therapeutically effective amount" may vary depending on the RNAi agent, how the agent is administered, the disease and its severity and the history, age, weight, family history, genetic makeup, stage of pathological processes mediated by TTR expression, the types of preceding or concomitant treatments, if any, and other individual characteristics of the patient to be treated.

"Prophylactically effective amount," as used herein, is intended to include the amount of an RNAi agent that, when administered to a subject who does not yet experience or display symptoms of a TTR-associated disease, but who may be predisposed to the disease, is sufficient to prevent or ameliorate the disease or one or more symptoms of the disease. Symptoms that may be ameliorated include sensory neuropathy (e.g., paresthesia, hypesthesia in distal limbs), autonomic neuropathy (e.g., gastrointestinal dysfunction, such as gastric ulcer, or orthostatic hypotension), motor neuropathy, seizures, dementia, myelopathy, polyneuropathy, carpal tunnel syndrome, autonomic insufficiency, cardiomyopathy, vitreous opacities, renal insufficiency, nephropathy, substantially reduced mBMI (modified Body Mass Index), cranial nerve dysfunction, and corneal lattice dystrophy. Ameliorating the disease includes slowing the course of the disease or reducing the severity of later-developing disease. The "prophylactically effective amount" may vary depending on the RNAi agent, how the agent is administered, the degree of risk of disease, and the history, age, weight, family history, genetic makeup, the types of preceding or concomitant treatments, if any, and other individual characteristics of the patient to be treated.

A "therapeutically-effective amount" or "prophylacticaly effective amount" also includes an amount of an RNAi agent that produces some desired local or systemic effect at a reasonable benefit/risk ratio applicable to any treatment. RNAi agents employed in the methods of the present invention may be administered in a sufficient amount to produce a reasonable benefit/risk ratio applicable to such treatment.

As used herein, the phrases "therapeutically effective amount" and "prophylactically effective amount" also include an amount that provides a benefit in the treatment, prevention, or management of pathological processes or symptom(s) of pathological processes mediated by TTR expression. Symptoms of TTR amyloidosis include sensory neuropathy (e.g. paresthesia, hypesthesia in distal limbs), autonomic neuropathy (e.g., gastrointestinal dysfunction, such as gastric ulcer, or orthostatic hypotension), motor neuropathy, seizures, dementia, myelopathy, polyneuropathy, carpal tunnel syndrome, autonomic insufficiency, cardiomyopathy, vitreous opacities, renal insufficiency, nephropathy, substantially reduced mBMI (modified Body Mass Index), cranial nerve dysfunction, and corneal lattice dystrophy.

The dose of an RNAi agent that is administered to a subject may be tailored to balance the risks and benefits of a particular dose, for example, to achieve a desired level of TTR gene suppression (as assessed, e.g., based on TTR mRNA suppression, TTR protein expression, or a reduction in an amyloid deposit, as defined above) or a desired therapeutic or prophylactic effect, while at the same time avoiding undesirable side effects.

In one embodiment, the RNAi agent is administered at a dose of between about 0.25 mg/kg to about 50 mg/kg, e.g., between about 0.25 mg/kg to about 0.5 mg/kg, between about 0.25 mg/kg to about 1 mg/kg, between about 0.25 mg/kg to about 5 mg/kg, between about 0.25 mg/kg to about 10 mg/kg, between about 1 mg/kg to about 10 mg/kg, between about 5 mg/kg to about 15 mg/kg, between about 10 mg/kg to about 20 mg/kg, between about 15 mg/kg to about 25 mg/kg, between about 20 mg/kg to about 30 mg/kg, between about 25 mg/kg to about 35 mg/kg, or between about 40 mg/kg to about 50 mg/kg.

In some embodiments, the RNAi agent is administered at a dose of about 0.25 mg/kg, about 0.5 mg/kg, about 1 mg/kg, about 2 mg/kg, about 3 mg/kg, about 4 mg/kg, about 5 mg/kg, about 6 mg/kg, about 7 mg/kg, about 8 mg/kg, about 9 mg/kg, about 10 mg/kg, about 11 mg/kg, about 12 mg/kg, about 13 mg/kg, about 14 mg/kg, about 15 mg/kg, about 16 mg/kg, about 17 mg/kg, about 18 mg/kg, about 19 mg/kg, about 20 mg/kg, about 21 mg/kg, about 22 mg/kg, about 23 mg/kg, about 24 mg/kg, about 25 mg/kg, about 26 mg/kg, about 27 mg/kg, about 28 mg/kg, about 29 mg/kg, 30 mg/kg, about 31 mg/kg, about 32 mg/kg, about 33 mg/kg, about 34 mg/kg, about 35 mg/kg, about 36 mg/kg, about 37 mg/kg, about 38 mg/kg, about 39 mg/kg, about 40 mg/kg, about 41 mg/kg, about 42 mg/kg, about 43 mg/kg, about 44 mg/kg, about 45 mg/kg, about 46 mg/kg, about 47 mg/kg, about 48 mg/kg, about 49 mg/kg or about 50 mg/kg.

In some embodiments, the RNAi agent is administered in two or more doses. If desired to facilitate repeated or frequent infusions, implantation of a delivery device, e.g., a pump, semi-permanent stent (e.g., intravenous, intraperitoneal, intracisternal or intracapsular), or reservoir may be advisable. In some embodiments, the number or amount of subsequent doses is dependent on the achievement of a desired effect, e.g., the suppression of a TTR gene, or the achievement of a therapeutic or prophylactic effect, e.g., reducing an amyloid deposit or reducing a symptom of a TTR-associated disease. In some embodiments, the RNAi agent is administered according to a schedule. For example, the RNAi agent may be administered twice per week, three times per week, four times per week, or five times per week. In some embodiments, the schedule involves regularly spaced administrations, e.g., hourly, every four hours, every six hours, every eight hours, every twelve hours, daily, every 2 days, every 3 days, every 4 days, every 5 days, weekly, biweekly, or monthly. In other embodiments, the schedule involves closely spaced administrations followed by a longer period of time during which the agent is not administered. For example, the schedule may involve an initial set of doses that are administered in a relatively short period of time (e.g., about every 6 hours, about every 12 hours, about every 24 hours, about every 48 hours, or about every 72 hours) followed by a longer time period (e.g., about 1 week, about 2 weeks, about 3 weeks, about 4 weeks, about 5 weeks, about 6 weeks, about 7 weeks, or about 8 weeks) during which the RNAi agent is not administered. In one embodiment, the RNAi agent is initially administered hourly and is later administered at a longer interval (e.g., daily, weekly, biweekly, or monthly). In another embodiment, the RNAi agent is initially administered daily and is later administered at a longer interval (e.g., weekly, biweekly, or monthly). In certain embodiments, the longer interval increases over time or is determined based on the achievement of a desired effect. In a specific embodiment, the RNAi agent is administered once daily during a first week, followed by weekly dosing starting on the eighth day of administration. In another specific embodiment, the RNAi agent is administered every other day during a first week followed by weekly dosing starting on the eighth day of administration.

Any of these schedules may optionally be repeated for one or more iterations. The number of iterations may depend on the achievement of a desired effect, e.g., the suppression of a TTR gene, retinol binding protein level, vitamin A level, and/or the achievement of a therapeutic or prophylactic effect, e.g., reducing an amyloid deposit or reducing a symptom of a TTR-associated disease.

In some embodiments, the RNAi agent is administered with other therapeutic agents or other therapeutic regimens. For example, other agents or other therapeutic regimens suitable for treating a TTR-associated disease may include a liver transplant, which can reduce mutant TTR levels in the body; Tafamidis (Vyndaqel), which kinetically stabilizes the TTR tetramer preventing tetramer dissociation required for TTR amyloidogenesis; and diuretics, which may be employed, for example, to reduce edema in TTR amyloidosis with cardiac involvement.

In one embodiment, a subject is administered an initial dose and one or more maintenance doses of an RNAi agent. The maintenance dose or doses can be the same or lower than the initial dose, e.g., one-half of the initial dose. A maintenance regimen can include treating the subject with a dose or doses ranging from 0.01 μg to 15 mg/kg of body weight per day, e.g., 10 mg/kg, 1 mg/kg, 0.1 mg/kg, 0.01 mg/kg, 0.001 mg/kg, or 0.00001 mg/kg of bodyweight per day. The maintenance doses are, for example, administered no more than once every 2 days, once every 5 days, once every 7 days, once every 10 days, once every 14 days, once every 21 days, or once every 30 days. Further, the treatment regimen may last for a period of time which will vary depending upon the nature of the particular disease, its severity and the overall condition of the patient. In certain embodiments the dosage may be delivered no more than once per day, e.g., no more than once per 24, 36, 48, or more hours, e.g., no more than once every 5 or 8 days. Following treatment, the patient can be monitored for changes in his/her condition. The dosage of the RNAi agent may either be increased in the event the patient does not respond significantly to current dosage levels, or the dose may be decreased if an alleviation of the symptoms of the disease state is observed, if the disease state has been ablated, or if undesired side-effects are observed.

VI. Kits

The present invention also provides kits for performing any of the methods of the invention. Such kits include one or more RNAi agent(s) and instructions for use, e.g., instructions for inhibiting expression of a TTR in a cell by contacting the cell with the RNAi agent(s) in an amount effective to inhibit expression of the TTR. The kits may optionally further comprise means for contacting the cell with the RNAi agent (e.g., an injection device), or means for measuring the inhibition of TTR (e.g., means for measuring the inhibition of TTR mRNA or TTR protein). Such means for measuring the inhibition of TTR may comprise a means for obtaining a sample from a subject, such as, e.g., a plasma sample. The kits of the invention may optionally further comprise means for administering the RNAi agent(s) to a subject or means for determining the therapeutically effective or prophylactically effective amount.

This invention is further illustrated by the following examples which should not be construed as limiting. The contents of all references and published patents and patent applications cited throughout the application are hereby incorporated herein by reference.

EXAMPLES

Example 1

Inhibition of TTR with TTR-GalNAc Conjugates

A single dose of the TTR RNAi agent AD-43527 was administered to mice subcutaneously and TTR mRNA levels were determined 72 hours post administration.

The mouse/rat cross-reactive GalNAc-conjugate, AD-43527, was chosen for in vivo evaluation in WT C57BL/6 mice for silencing of TTR mRNA in liver. The sequence of each strand of AD-43527 is shown below.

```
Duplex #   Strand  Oligo    Sequence 5' to 3'

AD-43527   s       A-       AfaCfaGfuGfuUfcUfuGfcUfcUfaUfaAfL96 (SEQ ID NO: 8)
                   89592 as      A-       uUfaUfaGfaGfcAfaGfaAfcAfcUfgUfusUfsu (SEQ ID NO: 9)
                   83989
                            L96 = GalNAc3; lowercase nts (a, u, g, c) are
                            2'-O-methyl nucleotides, Nf (i.e., Af) is a
                            2'-fluoro nucleotide
```

Strand: s = sense; as = antisense

The ligand used was GalNAc$_3$:

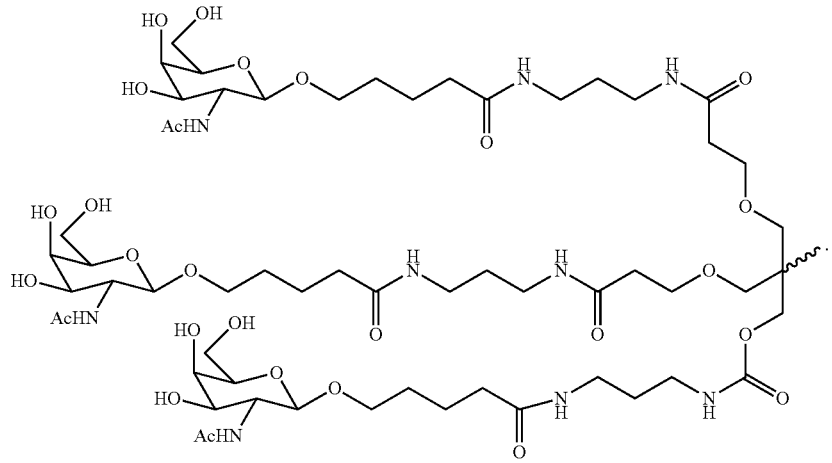 [SMILES: CC(=O)NC1C(OCCCCC(=O)NCCCNC(=O)CCOCC(C)(COCCC(=O)NCCCNC(=O)CCCCOC2OC(CO)C(O)C(O)C2NC(C)=O)COC(=O)NCCCNC(=O)CCCCOC2OC(CO)C(O)C(O)C2NC(C)=O)OC(CO)C(O)C1O]

This GalNAc3 ligand was conjugated to the 3'-end of the sense strand using the linker and tether as shown below:

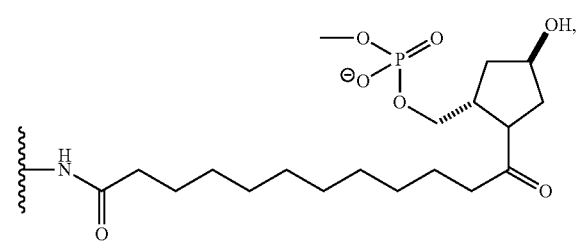 [SMILES: *NC(=O)CCCCCCCCCCC(=O)C1C[C@H](O)C[C@H]1COP(=O)([O-])OC]

The structure of the resulting GalNAc₃ conjugated sense strand is shown in the following schematic:

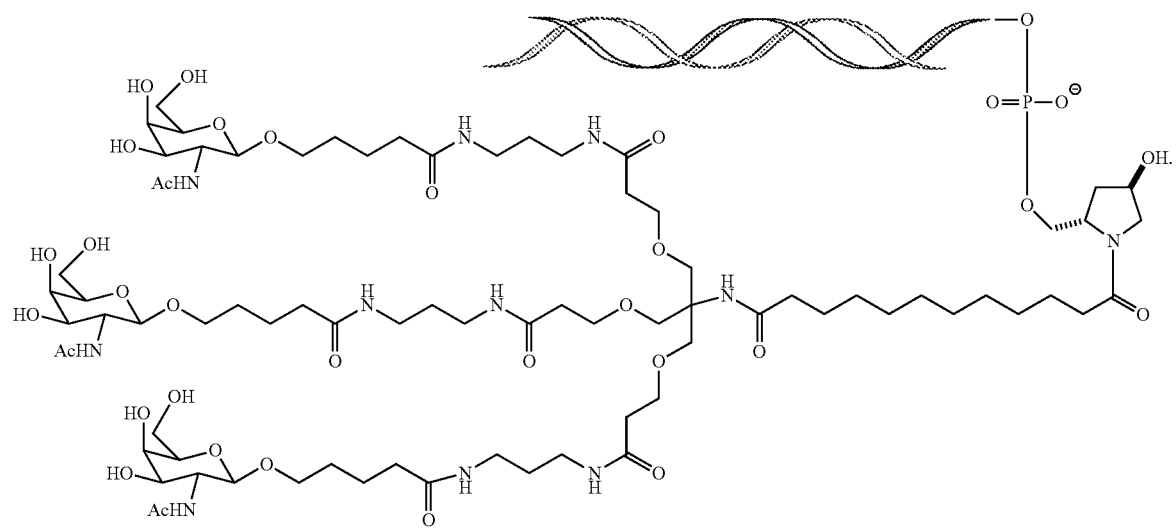 [SMILES: COP(=O)([O-])OC[C@@H]1C[C@@H](O)CN1C(=O)CCCCCCCCCCC(=O)NC(COCCC(=O)NCCCNC(=O)CCCCOC1OC(CO)C(O)C(O)C1NC(C)=O)(COCCC(=O)NCCCNC(=O)CCCCOC1OC(CO)C(O)C(O)C1NC(C)=O)COCCC(=O)NCCCNC(=O)CCCCOC1OC(CO)C(O)C(O)C1NC(C)=O]

L96=GalNAc₃; lowercase nts (a,u,g,c) are 2'-O-methyl nucleotides, Nf (i.e., Af) is a 2'-fluoro nucleotide; Q11 is cholesterol; s is phosphorothioate.

AD-43527 was administered to female C57BL/6 mice (6-10 weeks, 5 per group) via subcutaneous injection at a dose volume of 10 µl/g at a dose of 30, 15, 7.5, 3.5, 1.75 or 0.5 mg/kg of AD-43527. Control animals received PBS by subcutaneous injection at the same dose volume.

After approximately seventy two hours, mice were anesthetized with 200 µl of ketamine, and then exsanguinated by severing the right caudal artery. Liver tissue was collected, flash-frozen and stored at −80° C. until processing.

Efficacy of treatment was evaluated by measurement of TTR mRNA in the liver at 72 hours post-dose. TTR liver mRNA levels were assayed utilizing the Branched DNA assays—QuantiGene 1.0 (Panomics). Briefly, mouse liver samples were ground and tissue lysates were prepared. Liver lysis mixture (a mixture of 1 volume of lysis mixture, 2 volume of nuclease-free water and 10 µl of Proteinase-K/ml for a final concentration of 20 mg/ml) was incubated at 65° C. for 35 minutes. 5 µl of liver lysate and 95 µl of working probe set (TTR probe for gene target and GAPDH for endogenous control) were added into the Capture Plate. Capture Plates were incubated at 53° C.±1° C. (aprx. 16-20 hrs). The next day, the Capture Plates were washed 3 times with 1× Wash Additional RNAi agents that target TTR and have the following sequences and modifications were synthesized and assayed.

| Mouse/rat cross reactive TTR RNAi agents | | |
|---|---|---|
| Duplex | Sense strand 5'-3' | Antisense strand 5'-3' |
| AD-43528 | AfaCfaGfuGfuUfcUfuGfcUfcUfaUfaAfQ11L96 (SEQ ID NO: 10) | uUfaUfaGfaGfcAfaGfaAfcAfcUfgUfusUfsu (SEQ ID NO: 11) |

Human/cyno cross reactive TTR RNAi agents; parent duplex is AD-18328 [having a sense strand 5'-3' sequence of GuAAc-cAAGAGuAuuccAudTdT (SEQ ID NO: 12) and antisense strand 5' to 3' sequence of AUGGAAuACUCUUGG-UuACdTdT (SEQ ID NO: 13) with the following modifications: alternating 2'F/2'OMe w/2 PS on AS.

| Duplex | Sense strand 5'-3' | Antisense strand 5'-3' |
|---|---|---|
| AD-45163 | AfuGfuAfaCfcAfaGfaGfuAfuUfcCfaUfL96 (SEQ ID NO: 14) | aUfgGfaAfuAfcUfcUfuGfgUfuAfcAfusGfsa (SEQ ID NO: 16) |
| AD-45164 | AfuGfuAfaCfcAfaGfaGfuAfuUfcCfaUfQ11L96 (SEQ ID NO: 15) | aUfgGfaAfuAfcUfcUfuGfgUfuAfcAfusGfsa (SEQ ID NO: 17) |

Buffer (nuclease-free water, Buffer Component 1 and Wash Buffer Component 2), then dried by centrifuging for 1 minute at 240 g. 100 µl of Amplifier Probe mix per well was added into the Capture Plate, which was sealed with aluminum foil and incubated for 1 hour at 46° C.±1° C. Following a 1 hour incubation, the wash step was repeated, then 100 µl of Label Probe mix per well was added. Capture plates were incubated at 46° C.±1° C. for 1 hour. The plates were then washed with 1× Wash Buffer, dried and 100 µl substrate per well was added into the Capture Plates. Capture Plates were incubated for 30 minutes at 46° C. followed by incubation for 30 minutes at room temperature. Plates were read using the SpectraMax Luminometer following incubation. bDNA data were analyzed by subtracting the average background from each duplicate sample, averaging the resultant duplicate GAPDH (control probe) and TTR (experimental probe) values, and then computing the ratio: (experimental probe-background)/(control probe-background). The average TTR mRNA level was calculated for each group and normalized to the PBS group average to give relative TTR mRNA as a % of the PBS control group.

The results are shown in FIG. 1. The GalNAc conjugated RNAi agent targeting TTR had an $ED_{50}$ of approximately 5 mg/kg for TTR mRNA knockdown. These results demonstrate that GalNAc conjugated RNAi agents that target TTR are effective at inhibiting expression of TTR mRNA.

Example 2

Inhibition of TTR with TTR-GalNAc Conjugates is Durable

Mice were administered a subcutaneous dose (either 7.5 or 30.0 mg/kg) of AD-43527, a GalNAc conjugated RNAi agent that targets TTR. The TTR mRNA levels in the liver were evaluated at 1, 3, 5, 7, 10, 13, 15, 19, 26, 33, and 41 days post treatment using the method described in Example 1.

Figure 2:
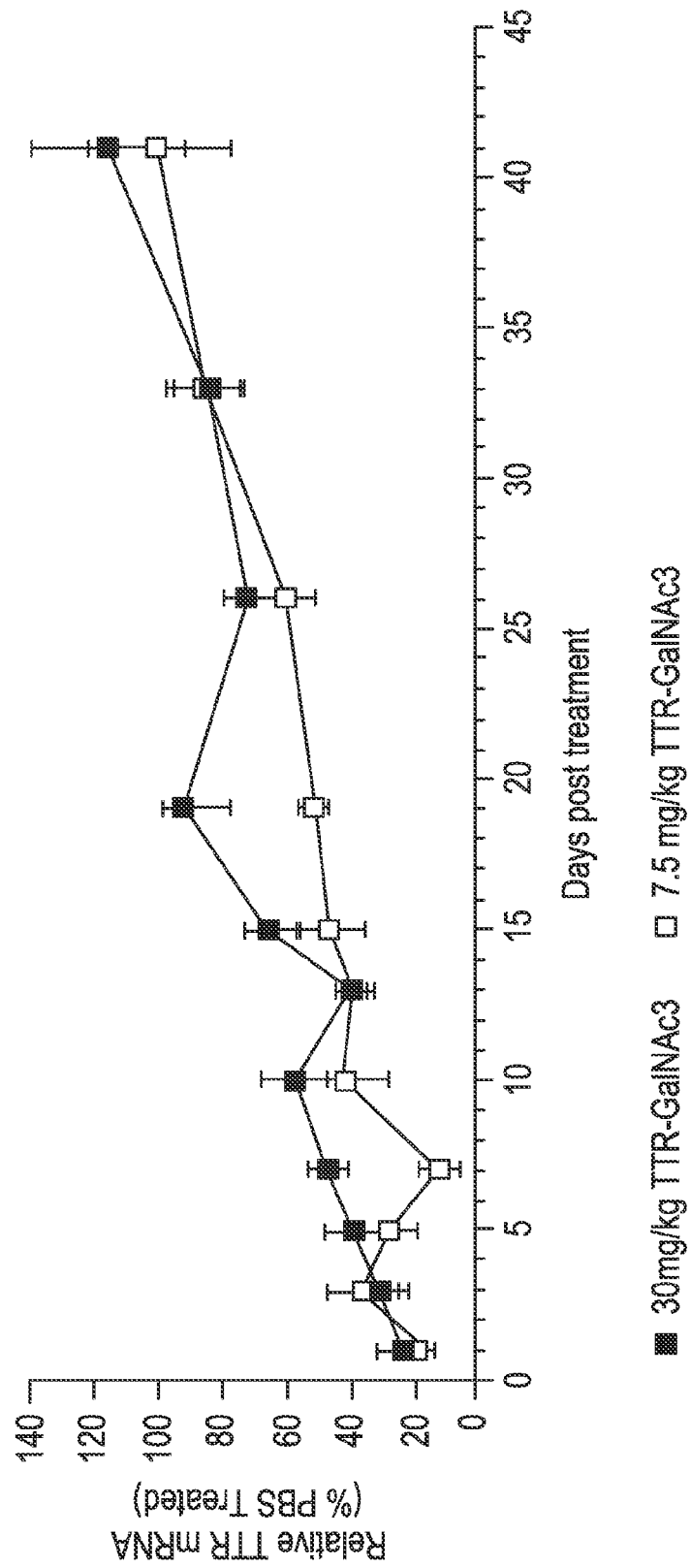
FIG. 2 is a graph depicting that administering to mice a single subcutaneous dose of 7.5 mg/kg or 30 mg/kg of a GalNAc conjugated RNAi agent targeting TTR resulted in long lasting suppression of TTR mRNA.

The results are shown in FIG. 2. At day 19, administration of 30.0 mg/kg GalNAc conjugated RNAi agents still showed about 50% silencing. Full recovery of expression occurred at day 41.

These results demonstrated that the inhibition provided by GalNAc conjugated siRNA targeting TTR is durable, lasting up to 3, 5, 7, 10, 13, 15, 19, 26 or 33 days post treatment.

Example 3

RNA Synthesis and Duplex Annealing

1. Oligonucleotide Synthesis

Oligonucleotides were synthesized on an AKTAoligopilot synthesizer or an ABI 394 synthesizer. Commercially available controlled pore glass solid support (dT-CPG, 500 Å, Prime Synthesis) and RNA phosphoramidites with standard protecting groups, 5'-O-dimethoxytrityl N6-benzoyl-2'-t-butyldimethylsilyl-adenosine-3'-O—N,N'-diisopropyl-2-cyanoethylphosphoramidite, 5'-O-dimethoxytrityl-N4-acetyl-2'-t-butyldimethylsilyl-cytidine-3'-O—N,N'-diisopropyl-2-cyanoethylphosphoramidite, 5'-O-dimethoxytrityl-N2-isobutryl-2'-t-butyldimethylsilyl-guanosine-3'-O—N,N'-diisopropyl-2-cyanoethylphosphoramidite, and 5'-O-dimethoxytrityl-2'-t-butyldimethylsilyl-uridine-3'-O—N,N'-diisopropyl-2-cyanoethylphosphoramidite (Pierce Nucleic Acids Technologies) were used for the oligonucleotide synthesis unless otherwise specified. The 2'-F phosphoramidites, 5'-O-dimethoxytrityl-N4-acetyl-2'-fluoro-cytidine-3'-O—N, N'-diisopropyl-2-cyanoethyl-phosphoramidite and 5'-O-dimethoxytrityl-2'-fluoro-uridine-3'-O—N,N'-diisopropyl-2-cyanoethyl-phosphoramidite were purchased from (Promega). All phosphoramidites were used at a concentration of 0.2M in acetonitrile ($CH_3CN$) except for guanosine which was used at 0.2M concentration in 10% THF/ANC (v/v). Coupling/recycling time of 16 minutes was used. The activator was 5-ethyl thiotetrazole (0.75M, American International Chemicals), for the PO-oxidation Iodine/Water/Pyridine was used and the PS-oxidation PADS (2%) in 2,6-lutidine/ACN (1:1 v/v) was used.

Ligand conjugated strands were synthesized using a solid support containing the corresponding ligand. For example, the introduction of a carbohydrate moiety/ligand (for e.g., GalNAc) at the 3'-end of a sequence was achieved by starting the synthesis with the corresponding carbohydrate solid support. Similarly a cholesterol moiety at the 3'-end was introduced by starting the synthesis on the cholesterol support. In general, the ligand moiety was tethered to trans-4-hydroxyprolinol via a tether of choice as described in the previous examples to obtain a hydroxyprolinol-ligand moiety. The hydroxyprolinol-ligand moiety was then coupled to a solid support via a succinate linker or was converted to phosphoramidite via standard phosphitylation conditions to obtain the desired carbohydrate conjugate building blocks. Fluorophore labeled siRNAs were synthesized from the corresponding phosphoramidite or solid support, purchased from Biosearch Technologies. The oleyl lithocholic $(GalNAc)_3$ polymer support made in house at a loading of 38.6 µmol/gram. The Mannose $(Man)_3$ polymer support was also made in house at a loading of 42.0 µmol/gram.

Conjugation of the ligand of choice at the desired position, for example at the 5'-end of the sequence, was achieved by coupling of the corresponding phosphoramidite to the growing chain under standard phosphoramidite coupling conditions unless otherwise specified. An extended 15 minute coupling of 0.1M solution of phosphoramidite in anhydrous $CH_3CN$ in the presence of 5-(ethylthio)-1H-tetrazole activator to a solid bound oligonucleotide. Oxidation of the internucleotide phosphite to the phosphate was carried out using standard iodine-water as reported in Beaucage, S. L. (2008) Solid-phase synthesis of siRNA oligonucleotides. *Curr. Opin. Drug Discov. Devel.*, 11, 203-216; Mueller, S., Wolf, J. and Ivanov, S. A. (2004) Current Strategies for the Synthesis of RNA. *Curr. Org. Synth.*, 1, 293-307; Xia, J., Noronha, A., Toudjarska, I., Li, F., Akinc, A., Braich, R., Frank-Kamenetsky, M., Rajeev, K. G., Egli, M. and Manoharan, M. (2006) Gene Silencing Activity of siRNAs with a Ribo-difluorotoluoyl Nucleotide. *ACS Chem. Biol.*, 1, 176-183 or by treatment with tert-butyl hydroperoxide/acetonitrile/water (10:87:3) with a 10 minute oxidation wait time conjugated oligonucleotide. Phosphorothioate was introduced by the oxidation of phosphite to phosphorothioate by using a sulfur transfer reagent such as DDTT (purchased from AM Chemicals), PADS and or Beaucage reagent The cholesterol phosphoramidite was synthesized in house, and used at a concentration of 0.1 M in dichloromethane. Coupling time for the cholesterol phosphoramidite was 16 minutes.

2. Deprotection-I (Nucleobase Deprotection)

After completion of synthesis, the support was transferred to a 100 ml glass bottle (VWR). The oligonucleotide was cleaved from the support with simultaneous deprotection of base and phosphate groups with 80 mL of a mixture of ethanolic ammonia [ammonia:ethanol (3:1)] for 6.5 h at 55° C. The bottle was cooled briefly on ice and then the ethanolic ammonia mixture was filtered into a new 250 ml bottle. The CPG was washed with 2×40 mL portions of ethanol/water (1:1 v/v). The volume of the mixture was then reduced to ~30 ml by roto-vap. The mixture was then frozen on dry ice and dried under vacuum on a speed vac.

3. Deprotection-II (Removal of 2' TBDMS group)

The dried residue was resuspended in 26 ml of triethylamine, triethylamine trihydrofluoride (TEA.3HF) or pyridine-HF and DMSO (3:4:6) and heated at 60° C. for 90 minutes to remove the tert-butyldimethylsilyl (TBDMS) groups at the 2' position. The reaction was then quenched with 50 ml of 20 mM sodium acetate and pH adjusted to 6.5, and stored in freezer until purification.

4. Analysis

The oligonucleotides were analyzed by high-performance liquid chromatography (HPLC) prior to purification and selection of buffer and column depends on nature of the sequence and or conjugated ligand.

5. HPLC Purification

The ligand conjugated oligonucleotides were purified by reverse phase preparative HPLC. The unconjugated oligonucleotides were purified by anion-exchange HPLC on a TSK gel column packed in house. The buffers were 20 mM sodium phosphate (pH 8.5) in 10% $CH_3CN$ (buffer A) and 20 mM sodium phosphate (pH 8.5) in 10% $CH_3CN$, 1M NaBr (buffer B). Fractions containing full-length oligonucleotides were pooled, desalted, and lyophilized. Approximately 0.15 OD of desalted oligonucleotidess were diluted in water to 150 μl and then pipetted in special vials for CGE and LC/MS analysis. Compounds were finally analyzed by LC-ESMS and CGE.

6. RNAi Agent Preparation

For the preparation of an RNAi agent, equimolar amounts of sense and antisense strand were heated in 1×PBS at 95° C. for 5 minutes and slowly cooled to room temperature. The integrity of the duplex was confirmed by HPLC analysis. Table 1 below reflects the RNAi agents which target human or rodent TTR mRNA.

TABLE 1

RNAi Agents and Results of In Vitro Screening

| Duplex ID | SEQ ID s ID NO: | Sense strand (S) | SEQ ID AS ID NO: | Antisense strand (AS) | % of mRNA remained conc. of siRNA | | | | IC50 (nM) |
|---|---|---|---|---|---|---|---|---|---|
| | | | | | 1 nM | 0.1 nM | 0.01 nM | | |
| D1000 | S1000 18 | AfuGfuAfafcAfAfGfaGfuAfuUfcCfasu | AS1000 1110 | AfuGfGfaAfuAfcUfcuuGfgUfuAfcAfusGfsa | 0.03 | 0.1 | 0.47 | | 0.006 |
| D1001 | S1001 19 | AfsuGfuAfcfcAfCfcAfAfGfaGfuAfuuCfasUf | AS1001 1111 | aUfsgGfAfAfuAfcUfcuuGfgUfuAfcAfusGfsa | 0.03 | 0.10 | 0.49 | | 0.0065 |
| D1002 | S1002 20 | AfuGfuAfafcAfcfcAfAfGfaGfuAfuAfuuCfasUf | AS1002 1112 | aUfgGfAfAfuAfcUfcuuGfgsUfuAfcAfusGfsa | 0.04 | 0.10 | 0.46 | | 0.0068 |
| D1003 | S1003 21 | AfuGfuAfafcAfcfcAfAfGfaGfuAfuuuCfasUf | AS1003 1113 | aUfgGfGfAfAfuAfcUfcuuGfgUfsuAfcAfusGfsa | 0.05 | 0.12 | 0.56 | | 0.0073 |
| D1004 | S1004 22 | aUfgaAfCfcAfGfaGfuUfAfuuCfcasu | AS1004 1114 | AUggAfAfuaCUfcuUfGgguUfAfcaUfsGfsa | 0.07 | 0.13 | 0.44 | | 0.008 |
| D1005 | S1005 23 | AfuGfuAfcfcAfAfGfaGfuAfuuCfasUf | AS1005 1115 | aUfgGfGfAfAfuAfcUfcuuGfgUfsuAfcAfusGfsa | 0.06 | 0.11 | 0.53 | | 0.0093 |
| D1006 | S1006 24 | AfuGfuAfAfccAfAfGfaGfuAfuUfcCfasUf | AS1006 1116 | aUfgGfaAfuAfcUfcuuGfuuAfcAfusGfsa | 0.05 | 0.16 | 0.55 | | 0.0095 |
| D1007 | S1007 25 | AfuGfuAfAfCfcAfAfGfaGfuAfuuUfcCfasUf | AS1007 1117 | aUfgGfaAfuAfcUfcuuGfguuAfcAfusGfsa | 0.05 | 0.14 | 0.48 | | 0.0098 |
| D1008 | S1008 26 | auguaaccaadGaGudAudAcdGasu | AS1008 1118 | aUfgGfaAfuAfcUfcUfuGfgUfuAfcAfusGfsa | 0.07 | 0.11 | 0.33 | | 0.010 |
| D1009 | S1009 27 | UfgGfGfAfAfuUfuCfAfUfGfuFaAfcCfAfAfgsAf | AS1009 1119 | uCfuugGfuUfaCfaugAfaAfiuccCfasUfsc | 0.03 | 0.14 | 0.56 | | 0.0101 |
| D1010 | S1010 28 | UfgGfgauUfuCfAfUfgUfaAfcCfaAfgsAf | AS1010 1120 | uCfuUfgGfUfuCfaCfaugAfaAfAfUfccCfasUfsc | 0.03 | 0.14 | 0.65 | | 0.0101 |
| D1011 | S1011 29 | aUfGfuAfAfcCfAfAfGfaGfuAfuIfUfcCfasUf | AS1011 1121 | aUfgGfaAfuAfcUfcuuGfguAfcAfUfsgsa | 0.06 | 0.10 | 0.55 | | 0.011 |
| D1012 | S1012 30 | UfgGfgAfuUfuCfAfUfGfUfaaCfaAfgsAf | AS1012 1122 | uCfuUfgGfUfUfaCfaugAfaAfuCfcCfasUfsc | 0.04 | 0.13 | 0.54 | | 0.0114 |
| D1013 | S1013 31 | auguaaccaadGaGudAudAcdGasu | AS1013 1123 | aUfgGfaAfuAfcUfcUfugdGudTadCadTsgsa | 0.11 | 0.19 | 0.49 | | 0.011 |
| D1014 | S1014 32 | AfuGfuaaCfcAfAfGfaGfuAfuUfcCfasUf | AS1014 1124 | aUfgGfaAfuAfcUfcuuGfgUfuAfcAfusGfsa | 0.04 | 0.16 | 0.59 | | 0.013 |
| D1015 | S1015 33 | AfuguAfaccAfaGfAfgfaAfgfdTAfdTudCcdAsu | AS1015 1125 | dAUdGgdAadTAfdCUfcUfugfGfuAfcAfusGfsa | 0.07 | 0.15 | 0.51 | | 0.013 |
| D1016 | S1016 34 | auGfuAfAfcCfAfAfGfaGfuAfuUfcCfasUf | AS1016 1126 | aUfgGfaAfuAfcUfcuuGfgUfuAfcAfUfsGfsa | 0.05 | 0.14 | 0.64 | | 0.013 |
| D1017 | S1017 35 | UfgGfgAfuUfuCfAfUfgUfAfAfcCfaAfgsAf | AS1017 1127 | uCfuUfgGfuuaCfaugAfaAfuCfCfcasUfsc | 0.09 | 0.41 | 0.74 | | 0.0133 |
| D1018 | S1018 36 | AfuGfuAfaCfcAfAfGfaGfuAfuAfuUfcCfasUf | AS1018 1128 | aUfgGfaAfuAfcUfcuuGfgUfuAfcAfusGfsa | 0.03 | 0.14 | 0.61 | | 0.014 |
| D1019 | S1019 37 | AfuGfuAfaccAfaGfAfgfuAfuAfuUfcCfasUf | AS1019 1129 | aUfgGfaAfuAfcUfcuuGfgUfuAfcAfusGfsa | 0.02 | 0.2 | 0.7 | | 0.014 |
| D1020 | S1020 38 | AfsuGfuAfaCfcAfAfGfaGfuAfuuCfcCfasUf | AS1020 1130 | asUfsgGfAfAfuAfcUfcuuGfuuAfcAfusGfsa | 0.04 | 0.16 | 0.67 | | 0.0156 |
| D1021 | S1021 39 | aUfgUfaAfcAfagUfaUfCfcasUf | AS1021 1131 | aUfgGfAfAfuAfcUfCfcuuGfuuAfcAfusGfsgsa | 0.11 | 0.24 | 0.64 | | 0.016 |

TABLE 1-continued

RNAi Agents and Results of In Vitro Screening

| Duplex ID | s ID | SEQ ID NO: | Sense strand (S) | AS ID | SEQ ID NO: | Antisense strand (AS) | 1 nM | 0.1 nM | 0.01 nM | IC50 (nM) |
|---|---|---|---|---|---|---|---|---|---|---|
| D1022 | S1022 | 40 | dTdGggdAdTuudCdAugdTdAacdCdAagsdA | AS1022 | 1132 | udCdTugdGdTuadCdAugdAdAaudCdCcasdTsc | 0.08 | 0.27 | 0.64 | 0.0161 |
| D1023 | S1023 | 41 | AfsuGfuAfCfcAfAfGfaGfuAfuucCfaAfgsAf | AS1023 | 1133 | aUfgsGfAfAfAfcUfcuuGfgUfuAfcAfusGfsa | 0.03 | 0.19 | 0.63 | 0.0163 |
| D1024 | S1024 | 42 | UfgGfgAfuUfucCfAfUfguaAfcCfaAfgsAf | AS1024 | 1134 | uCfuUfgGfuUfAfCfaugAfaAfuCfcCfasUfsc | 0.05 | 0.25 | 0.69 | 0.0164 |
| D1025 | S1025 | 43 | UfgGfgAfuUfucCfAfUfgUfAfAfcCfaAfgsAf | AS1025 | 1135 | uCfuUfgGfuuaCfaugAfaAfuCfcCfasUfsc | 0.04 | 0.18 | 0.75 | 0.0166 |
| D1026 | S1026 | 44 | UfgGfgAfuUfucCfAfUfgUfaCfaAfcCfaAfgsAf | AS1026 | 1136 | uCfuUfgGfuUfaCfaugAfaAfuCfcCfasUfsc | 0.04 | 0.19 | 0.66 | 0.0178 |
| D1027 | S1027 | 45 | UfgGfgAfuUfucCfAfUfgUfgUfaAfcaAfgsAf | AS1027 | 1137 | uCfuUfgGfgUfaCfaugAfaAfuCfcCfasUfsc | 0.04 | 0.19 | 0.69 | 0.018 |
| D1028 | S1028 | 46 | dAdTgudAdAccdAdAgadGdTaudTdCcasdT | AS1028 | 1138 | adTdGgadAdTacdTdCuudGgGtuudAdCausdGsa | 0.15 | 0.29 | 0.72 | 0.018 |
| D1029 | S1029 | 47 | AdTGdTAdAcCdCAdAdAgAgAgAgTAdTudCCdAsU | AS1029 | 1139 | dAUdGGdAAdTAdCUdCUdTGdGUdTAdCAdTGsdA | 0.1 | 0.27 | 0.61 | 0.018 |
| D1030 | S1030 | 48 | UfgGfAfAtuuuCfAfUfgtAfAfcCfaAfgsAf | AS1030 | 1140 | uCfuUfgGfuUfaCfaugAfAfAfuccCfasUfsc | 0.04 | 0.21 | 0.64 | 0.0187 |
| D1031 | S1031 | 49 | AfuGfuAfAfccAfCfAfAfGfAfGfuaAfuccCfAfsu | AS1031 | 1141 | AfUfGfGfAfAfAfAfcUfcUfcUfUfGfuuAfcAfusGfsa | 0.06 | 0.15 | 0.62 | 0.019 |
| D1032 | S1032 | 50 | AfsuGfgAfuUfufuCfAfUfgUfaAcCfaAfgsAf | AS1032 | 1142 | asUfgGfAfAfAfuAfcUfcuuGfgUfsuAfcAfusGfsa | 0.09 | 0.34 | 0.78 | 0.021 |
| D1033 | S1033 | 51 | UfgGfgAfuUfucCfAfUfgUfaaacCfaAfgsAf | AS1033 | 1143 | uCfuUfgGfUfUfaCfaugAfaAfuCfcCfasUfsc | 0.06 | 0.26 | 0.57 | 0.0212 |
| D1034 | S1034 | 52 | AfuGfuAfAfccAfaGfAfUfAfUfgUfaAfcCfaAfgsAf | AS1034 | 1144 | aUfgGfaAfAfAfuAfcUfcUfgGfuAfcAfusGfsa | 0.11 | 0.39 | 0.82 | 0.0216 |
| D1035 | S1035 | 53 | UfgGfgAfuuuCfAfUfgUfaAfcCfaAfgsAf | AS1035 | 1145 | uCfuUfgGfuUfaCfaugAfaAfuCfcCfAsUfsc | 0.04 | 0.16 | 0.56 | 0.0222 |
| D1036 | S1036 | 54 | UfgGfgAfAfuUfucCfAfUfgUfaAfcCfAfAfgsAf | AS1036 | 1146 | uCfuugGfUfuAfCfAfugAfaAfuCfcCfasUfsc | 0.06 | 0.31 | 0.78 | 0.0234 |
| D1037 | S1037 | 55 | UfgGfgAfAfUfUfcCfAfUfgUfAfAfcCfAfAfgsAf | AS1037 | 1147 | uCfuUfgGfUfuaCfAfugAfaAfuCfcCfasUfsc | 0.03 | 0.14 | 0.62 | 0.0235 |
| D1038 | S1038 | 56 | UfgGfgAfUfUfUfcCfAfAfugtTfAfaccCfAfagsAf | AS1038 | 1148 | uCfuUfgGfuUfaCfAfugAfaAfuCfcCfAsUfsc | 0.09 | 0.39 | 0.78 | 0.0239 |
| D1039 | S1039 | 57 | AfuGfuAfacCfcAfAfGfaGfuAfuccCfAfsu | AS1039 | 1149 | aUfgGfAfAfAfuAfcUfcUfuGfgUfuAfcCfasUf | 0.03 | 0.14 | 0.59 | 0.025 |
| D1040 | S1040 | 58 | AfuGfuAfacCfcAfAfGfaGfuAfuUfccAfsU | AS1040 | 1150 | aUfgGfAfAfAfuAfcUfcuuGfgUfuAfcAfusGfsa | 0.03 | 0.13 | 0.56 | 0.025 |
| D1041 | S1041 | 59 | AfsuGfuAfacCfcAfAfGfaGfuAfuuCfccCfAsU | AS1041 | 1151 | asUfgGfAfAfAfAfuAfcUfcuuGfuUfuAfcAfusGfsa | 0.06 | 0.27 | 0.79 | 0.0252 |
| D1042 | S1042 | 60 | UfgGfgAfuuuCfAfAfUfgUfAfAfcCfaAfgsAf | AS1042 | 1152 | uCfuUfgGfuuaCfaugAfaAfuCfcCfAsUfsc | 0.05 | 0.27 | 0.67 | 0.0259 |
| D1043 | S1043 | 61 | AfuGfuAfacCfcAfAfGfaGfuauUfccCfasUf | AS1043 | 1153 | aUfgGfaAfuAfcUfcuuGfgUfuAfcAfusGfsa | 0.02 | 0.16 | 0.63 | 0.027 |

TABLE 1-continued

RNAi Agents and Results of In Vitro Screening

| Duplex ID | S ID | SEQ ID NO: | Sense strand (S) | AS ID | SEQ ID NO: | Antisense strand (AS) | % of mRNA remained conc. of siRNA | | | | IC50 (nM) |
|---|---|---|---|---|---|---|---|---|---|---|---|
| | | | | | | | 1 nM | 0.1 nM | 0.01 nM | | |
| D1044 | S1044 | 62 | AfsuGfuAfaCfcAfAfgGfaGfuUfuuCfasUf | AS1044 | 1154 | asUfgGfAfaAfaUfcuuGfgsUfsuAfcAfusGfsa | 0.06 | 0.30 | 0.81 | | 0.0271 |
| D1045 | S1045 | 63 | aUfguAfAfccAfAfgaGfauUfCfcasUf | AS1045 | 1155 | aUfGfgaAfUfacUfCfiuuGfGfuuAfCfaUfsgsa | 0.12 | 0.29 | 0.8 | | 0.028 |
| D1046 | S1046 | 64 | AfuGfuAfacCfcAfAfgaguAfuUfcCfasUf | AS1046 | 1156 | aUfgGfaAfUfacUfCfuuuGfgUfuAfcAfAfusgsa | 0.03 | 0.15 | 0.59 | | 0.030 |
| D1047 | S1047 | 65 | UfgGfGfAfuUfuCfaUfgUfAfAfcCfaAfgsAf | AS1047 | 1157 | uCfuUfgGfuuaCfaUfgAfaAfuccCfasUfsc | 0.08 | 0.44 | 0.83 | | 0.0324 |
| D1048 | S1048 | 66 | AfcGfuAfAfcCfcAfAfgGfuAfuUfCfasUf | AS1048 | 1158 | aUfgGfaAfUfacUfCfuuuGfgUfuAfcAfAfusGfsa | 0.07 | 0.23 | 0.67 | | 0.036 |
| D1049 | S1049 | 67 | AfuGfuAfAfcCfAfAfgGfAfGfuAfuuccAfsu | AS1049 | 1159 | AfuUfgGfgfAfAfuAfCfUfCfUfUfgGfUfuAfCfAfusGfsa | 0.08 | 0.23 | 0.73 | | 0.037 |
| D1050 | S1050 | 68 | UfgGfgAfuuuCfgUfiaAfcCfaAfgsAf | AS1050 | 1160 | uCfuugGfuUfaCfaUfgAfAfAfuCfcCfasUfsc | 0.06 | 0.29 | 0.78 | | 0.0372 |
| D1051 | S1051 | 69 | AfuGfuAfaccaagaguAfuUfcCfasUf | AS1051 | 1161 | aUfgGfaAfudAcdTcdTudggTuAfcAfusgsa | 0.12 | 0.41 | 0.86 | | 0.040 |
| D1052 | S1052 | 70 | AfuguAfaccAfaGfdAGfdAGfdTAdTUdCcdAsu | AS1052 | 1162 | aUfgGfaAfuAfcUfCfuuuGfgUfuAfcAfusGfsa | 0.1 | 0.22 | 0.72 | | 0.042 |
| D1053 | S1053 | 71 | AfiuguAfaccAfaGfdAGfdAGfdTAdTUdCcdAsu | AS1053 | 1163 | dAUdGGdAAfuAfudAdACUfcUfugGfgUfuAfcAfusGfsa | 0.09 | 0.31 | 0.69 | | 0.044 |
| D1054 | S1054 | 72 | AfuguAfaccAfaFfcAfaGfdAGfdTAfuFfcdCcdAsu | AS1054 | 1164 | adTdGGfaAfuAfudAdACUfcUfugGfgUfuAfcAfusGfsa | 0.1 | 0.45 | 0.75 | | 0.047 |
| D1055 | S1055 | 73 | AfuguAfaccAfaFfcAfaGfdAGfdTAdTUdCcdAsu | AS1055 | 1165 | dAUdGGdAadTAfcUfcUfugGfuudAcAfusGfsa | 0.12 | 0.26 | 0.7 | | 0.049 |
| D1056 | S1056 | 74 | AuGuAaCCaAgAgAuAuUcCasU | AS1056 | 1166 | aUgGaAuAcUcUuGgUuAcAusGsa | 0.08 | 0.24 | 0.65 | | 0.050 |
| D1057 | S1057 | 75 | AfuguAfaccAfagaGfuaaUfccasUf | AS1057 | 1167 | aUfGfGfaAfuAfcUfCfUfugGfUfuAfCfAfusGfsa | 0.14 | 0.42 | 0.62 | | 0.051 |
| D1058 | S1058 | 76 | AfuGfuAfaccaagaguAfuUfcCfasUf | AS1058 | 1168 | aUfgGfaAfudAcdTcdTudggTuAfcAfusGfsa | 0.12 | 0.36 | 0.86 | | 0.053 |
| D1059 | S1059 | 77 | AfuguAfaccAfagaGfdAGfdTAdTUdCcdAsu | AS1059 | 1169 | dAUdGGdAadTAfdCUfcUfugGfuUfAfcAfusGfsa | 0.09 | 0.27 | 0.7 | | 0.054 |
| D1060 | S1060 | 78 | adTguAdAccdAdAdAgagdTadTudCcasdT | AS1060 | 1170 | adTdGGdAadTadCdTdCuudGGuudAdCadTsgsa | 0.11 | 0.37 | 0.66 | | 0.056 |
| D1061 | S1061 | 79 | AfuGfuAfaccAfcAfgGfdAGuAfuUfcdCdAsu | AS1061 | 1171 | adTdGGfaAfuAfudGuAfcUfcUfugGfuUfAfcAfusGfsa | 0.1 | 0.31 | 0.77 | | 0.059 |
| D1062 | S1062 | 80 | AfuGfuAfaccAfaGfdAGfdTAdTUdCcdAsu | AS1062 | 1172 | aUfgGfaAfuAfcUfCfUfugGfUfuAfcAfusGfsa | 0.1 | 0.27 | 0.65 | | 0.059 |
| D1063 | S1063 | 81 | adTdGuadAdAcccAdAdGagdTdAuudCdAsu | AS1063 | 1173 | dAAfTggdAdAuadCdTdgudTdAcadTsdGsa | 0.12 | 0.44 | 0.82 | | 0.064 |
| D1064 | S1064 | 82 | AfuGfuAfcAfcAfaGfaGfdTAdTUdCcdAsu | AS1064 | 1174 | adTdGGfaAfuAfudAuadCdTdAuUfcdGfuUfAfcAfusGfsa | 0.12 | 0.32 | 0.83 | | 0.064 |
| D1065 | S1065 | 83 | AfuguAfaccAfagaGfdTAdTUdCcdAsu | AS1065 | 1175 | dAUdGgdAadTAfcUfcUfugGfuUfAfcAfusGfsa | 0.13 | 0.34 | 0.72 | | 0.066 |
| D1066 | S1066 | 84 | AfcGfuAfcfcAfaGfaGfdTUfcdCcdAsu | AS1066 | 1176 | adTdGGfadAdTAfcUfcUfugGfuUfAfcAfusGfsa | 0.11 | 0.33 | 0.72 | | 0.067 |

TABLE 1-continued

RNAi Agents and Results of In Vitro Screening

| Duplex ID | s ID | SEQ ID NO: | Sense strand (S) | AS ID | SEQ ID NO: | Antisense strand (AS) | % of mRNA remained conc. of siRNA 1 nM | 0.1 nM | 0.01 nM | IC50 (nM) |
|---|---|---|---|---|---|---|---|---|---|---|
| D1067 | S1067 | 85 | AfuguAfaccAfaGfaGfaGfTAdTUdCcdAsu | AS1067 | 1177 | aUfgGfaAfuAfcUfcUfgUfuAfcAfusGfsa | 0.11 | 0.37 | 0.62 | 0.070 |
| D1068 | S1068 | 86 | AfuguAfaccAfaGfaGfaGfTAdTUdCcdAsu | AS1068 | 1178 | dAUdGGdAAuAfcUfcUfgUfGfUfuAfCfAfusGfsa | 0.16 | 0.33 | 0.64 | 0.072 |
| D1069 | S1069 | 87 | aUfGfuaAfcfccAfGfagUfAfuuCfCfasu | AS1069 | 1179 | AfUfggAfAfuaCfUfuCfUfcUfGfgUfuAfcAfUfsGfsa | 0.14 | 0.43 | 0.73 | 0.074 |
| D1070 | S1070 | 88 | AfuGfuaAfcfcAfcFcAfaGfaguAfuUfcCfasu | AS1070 | 1180 | aUfgGfaAfuAfcUfcUfcUfuggUfuAfcAfusGfsa | 0.08 | 0.42 | 0.94 | 0.075 |
| D1071 | S1071 | 89 | UfgGfgAfuuuCfaUfgUfaAfcfaAfgsAf | AS1071 | 1181 | uCfuUfgGfuUfaCfaUfgAfAfAfucCfcAfusGfsc | 0.14 | 0.28 | 0.83 | 0.0797 |
| D1072 | S1072 | 90 | AfuGfuAfcfcAfaGfaGfuauUfcCfasUf | AS1072 | 1182 | aUfgGfaAfuAfcucUfuGfgUfuAfcAfusGfsa | 0.05 | 0.26 | 0.8 | 0.082 |
| D1073 | S1073 | 91 | AfuGfuAfcfcAfaGfaGfadGdTdAdTUfccfasUf | AS1073 | 1183 | aUfgGfadAdTdAdCUfcUfgUfuAfcAfusGfsa | 0.12 | 0.41 | 0.73 | 0.083 |
| D1074 | S1074 | 92 | AfuGfuAfAfccAfAfgaGfUfauUfCfCfasUf | AS1074 | 1184 | aUfgGfgaAfuAfcUfcUfuuGfuGfuAfCfausGfsa | 0.14 | 0.44 | 0.75 | 0.086 |
| D1075 | S1075 | 93 | AfuGfuAfAfcfcAfaGfaGfataUfCfCfasUf | AS1075 | 1185 | aUfgGfdAdAdGdAdTAfcUfcUfuGfuAfcAfusGfsa | 0.1 | 0.41 | 0.72 | 0.088 |
| D1076 | S1076 | 94 | AfuGfuAfcfcAfcfcAfaGfaGfudAdTdCCfasUf | AS1076 | 1186 | aUfgGfgAfAfTAfcUfcUfuGfuAfcAfusGfsa | 0.15 | 0.45 | 0.86 | 0.088 |
| D1077 | S1077 | 95 | AfuGfuAfcfcAfaGfaGfuAfUfuccfasu | AS1077 | 1187 | AfUfgGfAfAfuAfcucUfcUfuGfgUfuAfcAfusGfsa | 0.08 | 0.46 | 0.95 | 0.092 |
| D1078 | S1078 | 96 | AfuGfuAfcfcAfaGfaGfuAfuUfcCfasUf | AS1078 | 1188 | dAUdGGdAadTAfcUfcUfuGfuAfcAfusGfsa | 0.09 | 0.32 | 0.76 | 0.093 |
| D1079 | S1079 | 97 | AfuguAfaccAfaGfaGfaGfuAfuucCfasUf | AS1079 | 1189 | dAudGgdAadTdUdCcdAsu | 0.14 | 0.38 | 0.76 | 0.095 |
| D1080 | S1080 | 98 | AfuGfuAfcfcAfaGfaGfuAfuUfcCfasUf | AS1080 | 1190 | aUfgGfAfAfAfcucUfcUfgUfuAfcAfusGfsa | 0.05 | 0.42 | 0.86 | 0.099 |
| D1081 | S1081 | 99 | AfuGfuAfcfcAfaGfaGfuAfuUfdCdCdAsdT | AS1081 | 1191 | dAdTdGGdAdTAfcUfcUfgUfuAfcAfusGfsa | 0.17 | 0.47 | 0.9 | 0.105 |
| D1082 | S1082 | 100 | AfuGfuAfAfaccaagagudAfuUfcCfasUf | AS1082 | 1192 | aUfgGfaAfudACfudCfudGfudTAfcAfusgsa | 0.12 | 0.44 | 0.83 | 0.106 |
| D1083 | S1083 | 101 | AfuGfuAfcfcAfaGfaGfuAfuUfcCfasUf | AS1083 | 1193 | adTdGGdAfudAfdTdAcUfcUfgUfuAfcAfusGfsa | 0.11 | 0.34 | 0.74 | 0.109 |
| D1084 | S1084 | 102 | AfuGfuAfAfcfcAfaGfaGfuauUfcCfasUf | AS1084 | 1194 | aUfgGfaAfuAfcUfcUfuGfuuAfcAfusGfsa | 0.1 | 0.45 | 0.93 | 0.117 |
| D1085 | S1085 | 103 | AfuGfuAfcfcAfaGfaGfuauUfcCfasUf | AS1085 | 1195 | aUfgGfaAfuAfcUfcUfuGfuacAfusGfsa | 0.07 | 0.42 | 0.78 | 0.120 |
| D1086 | S1086 | 104 | aUfGfuAfcfcAfaGfaGfuAfuUfcCfasUf | AS1086 | 1196 | aUfgGfaAfuAfcUfcUfuuAfcAfsGfsa | 0.17 | 0.45 | 0.83 | 0.1197 |
| D1087 | S1087 | 105 | AfuGfuAfcfcAfaGfaGfuAfuUfcCfasu | AS1087 | 1197 | AfUfgGfaAfuacUfcUfgUfuAfcAfusGfsa | 0.05 | 0.3 | 0.7 | 0.120 |
| D1088 | S1088 | 106 | AfuGfuAfcfcAfaGfaGfuAfuUfcCfasUf | AS1088 | 1198 | aUfgGfaAfuAfcUfcUfgUfuAfcAfusgsa | 0.11 | 0.46 | 0.8 | 0.120 |

TABLE 1-continued

RNAi Agents and Results of In Vitro Screening

| Duplex ID | S ID | SEQ ID NO: | Sense strand (S) | AS ID | SEQ ID NO: | Antisense strand (AS) | % of mRNA remained conc. of siRNA 1 nM | 0.1 nM | 0.01 nM | IC50 (nM) |
|---|---|---|---|---|---|---|---|---|---|---|
| D1089 | S1089 | 107 | AfuGfuAfaCfcAfaGfaGfaGfuAfAfuUfccCfasUf | AS1089 | 1199 | aUfgGfaAfuacUfcUfuGfgUfuAfcAfusGfsa | 0.14 | 0.49 | 0.85 | 0.122 |
| D1090 | S1090 | 108 | AfuGfuAfaCfcAfaGfaGfaGfuauUfcCfasUf | AS1090 | 1200 | aUfgGfaAfuUfAfcUfcUfuGfgUfuAfcAfusGfsa | 0.1 | 0.41 | 0.85 | 0.125 |
| D1091 | S1091 | 109 | AfuguAfaCfcAfaGfaGfaGfdTadTudCcdAsu | AS1091 | 1201 | aUfgGfaAfuAfcUfcUfuGfgUfuAfcAfusGfsa | 0.16 | 0.38 | 0.77 | 0.125 |
| D1092 | S1092 | 110 | AfuGfuAfaCfcAfaGfaGfaGfuAfiuUfcCfasu | AS1092 | 1202 | AfuGfGfaAfAfucucUfuGfgUfuAfcAfusGfsa | 0.05 | 0.31 | 0.93 | 0.126 |
| D1093 | S1093 | 111 | auGfuAfaCfcAfaGfaGfaGfuAfiuUfcCfasUf | AS1093 | 1203 | aUfgGfaAfuAfcucUfuGfgUfuAfUfgGfsa | 0.06 | 0.33 | 0.9 | 0.135 |
| D1094 | S1094 | 112 | AfuGfuAfaCfcAfaGfaGfaGfuAfiuUfccasUf | AS1094 | 1204 | aUfgGfaAfuacUfcUfuGfgUfuAfcAfusGfsa | 0.07 | 0.39 | 0.85 | 0.142 |
| D1095 | S1095 | 113 | AfuGfuAfaCfcAfaGfaGfaGfuAfiuUfccasUf | AS1095 | 1205 | aUfgGfaAfuAfucucUfuGfgUfuAfcAfusGfsa | 0.09 | 0.39 | 0.76 | 0.146 |
| D1096 | S1096 | 114 | AfuGfuAfaCfcAfaGfaGfaGfuAfiuCfasUf | AS1096 | 1206 | aUfgGfaAfuacUfcUfuGfgUfuAfcAfusGfsa | 0.06 | 0.38 | 0.85 | 0.147 |
| D1097 | S1097 | 115 | AfuGfuAfaCfcAfaGfaGfaGfuAfAfuUfcCfasUf | AS1097 | 1207 | aUfgGfaAfuacUfcUfuGfgUfuacAfusGfsa | 0.12 | 0.47 | 0.87 | 0.147 |
| D1098 | S1098 | 116 | AfuGfuAfaCfcAfaGfaGfaGfuAfAfuUfcCfasUf | AS1098 | 1208 | aUfGfaauAfcUfcUfuGfgUfuAfcAfusGfsa | 0.06 | 0.42 | 0.85 | 0.151 |
| D1099 | S1099 | 117 | AfuGfuAfaCfcAfaGfaGfaGfuAfAfuUfcCfasUf | AS1099 | 1209 | dAUdGGdAadTAfdCUfcUfuGfgUfuAfcAfusGfsa | 0.16 | 0.41 | 0.85 | 0.152 |
| D1100 | S1100 | 118 | AfugAfaccAfaGfaGfaGfuAfAfuUfcCfasUf | AS1100 | 1210 | aUfgGfaAfuAfcUfcUfuGfgUfuAfcAfusGfsa | 0.15 | 0.48 | 0.72 | 0.152 |
| D1101 | S1101 | 119 | AfuGfuAfaCfcAfaGfaGfaGfuAfAfuUfccasUf | AS1101 | 1211 | aUfGfGfaAfuAfcUfcUfuGfgUfuAfcAfusGfsa | 0.06 | 0.38 | 0.94 | 0.158 |
| D1102 | S1102 | 120 | AfuGfuAfaccaagaguAfuUfcCfasUf | AS1102 | 1212 | aUfgGfaAfuAfdCuCfdTuGfdG uUfacAfusGfsa | 0.21 | 0.45 | 0.89 | 0.162 |
| D1103 | S1103 | 121 | AfuGfuaaCfCfAfaGfaGfuAfuUfcCfasUf | AS1103 | 1213 | aUfgGfaAfuAfcUfcUfuggUfuAfcAfusGfsa | 0.14 | 0.49 | 0.95 | 0.163 |
| D1104 | S1104 | 122 | AfuGfuAfaccAfaGfaGfaGfuAfuUfcCfasUf | AS1104 | 1214 | aUfgGfaAfuacUfcUfuGfGfuAfcAfusGfsa | 0.06 | 0.36 | 0.92 | 0.163 |
| D1105 | S1105 | 123 | AfuGfuAfaCfcAfaGfaGfaGfuAfuucCfasUf | AS1105 | 1215 | aUfgGfaAfuAfcUfcUfuGfgUfuAfcAfusGfsa | 0.1 | 0.45 | 0.84 | 0.167 |
| D1106 | S1106 | 124 | AfuGfuAfaCfcAfaGfaGfaGfuAfuUfcCfasUf | AS1106 | 1216 | aUfgGfaAfuAfcucUfuGfgUfuAfcAfusGfsa | 0.09 | 0.43 | 0.91 | 0.170 |
| D1107 | S1107 | 125 | AfuGfuAfaccAfaGfaGfaGfuAfuUfcCfasUf | AS1107 | 1217 | aUfgGfaAfuAfcUfcUfuGfgUfuAfcAfusGfsa | 0.09 | 0.46 | 1 | 0.171 |
| D1108 | S1108 | 126 | AfuguAfaccAfaGfaGfaGfdTadTudCcdAsu | AS1108 | 1218 | aUfgGfaAfuAfcUfcUfuGfgUfuAfcAfusGfsa | 0.11 | 0.39 | 0.71 | 0.176 |
| D1109 | S1109 | 127 | AfuGfuAfacfCfAfaGfaGfaGfuAfuUfcCfasUf | AS1109 | 1219 | aUfGfGfaAfuAfcUfcUfuGfgUfuacAfusGfsa | 0.1 | 0.43 | 0.9 | 0.180 |
| D1110 | S1110 | 128 | AfuGfuAfaCfcAfaGfaGfaGfuAfaguAfuUfcCfasUf | AS1110 | 1220 | aUfgGfaauAfcUfcUfuGfgUfuAfcAfusGfsa | 0.06 | 0.42 | 0.88 | 0.182 |
| D1111 | S1111 | 129 | AfuGfuAfaCfcAfaGfaGfaGfuAfuUfcCfasUf | AS1111 | 1221 | dAUdGGdAAuAfcUfcUfuGfGfUfuAfcFAfusGfsa | 0.18 | 0.49 | 0.79 | 0.183 |

TABLE 1-continued

RNAi Agents and Results of In Vitro Screening

| Duplex ID | s ID | SEQ ID NO: | Sense strand (S) | AS ID | SEQ ID NO: | Antisense strand (AS) | % of mRNA remained conc. of siRNA | | | | IC50 (nM) |
|---|---|---|---|---|---|---|---|---|---|---|---|
| | | | | | | | 1 nM | 0.1 nM | 0.01 nM | | |
| D1112 | S1112 | 130 | AfuGfUfAfaccAfaGfaGfAfUfAfuUfcCfasUf | AS1112 | 1222 | aUfgGfaAfuAfcUfcUfuGfCfUfuacAfusGfsa | 0.14 | 0.48 | 0.85 | | 0.195 |
| D1113 | S1113 | 131 | AfuGfUfAfacCfcAfaGfaGfaguAfuUfcCfasUf | AS1113 | 1223 | aUfgGfaAfuAfcUfcUfuCfgUfuGfaguUfacAfusGfsa | 0.09 | 0.41 | 0.85 | | 0.201 |
| D1114 | S1114 | 132 | auGfufAfacCfcAfaGfaGfAfUfAfuUfcCfasUf | AS1114 | 1224 | aUfgGfaAfuacUfcUfuGfgUfuGfUfaCfAfUfsGfsa | 0.05 | 0.44 | 0.94 | | 0.201 |
| D1115 | S1115 | 133 | AfuGfuAfAfacCfcAfaGfaGfUfAfUfAfuUfcCfasUf | AS1115 | 1225 | aUfgGfaAfuacUfcUfuGfgUfuGfUfAfCfAfusGfsa | 0.08 | 0.41 | 0.96 | | 0.204 |
| D1116 | S1116 | 134 | AfuGfUfAfCfcAfaGfaGfAfuUfAfuUfcCfasUf | AS1116 | 1226 | aTfdGfadAdTAfcUfcUfuGfUfgUfuAfcAfusGfsa | 0.15 | 0.47 | 0.79 | | 0.208 |
| D1117 | S1117 | 135 | AfuGfuaaCfUfcAfaGfaGfUfAfUfAfuUfcCfasUf | AS1117 | 1227 | aUfgGfaAfuacUfcUfuCfgUfuGfUfAfCfAfusGfsa | 0.08 | 0.42 | 0.92 | | 0.224 |
| D1118 | S1118 | 136 | auguaaccaagaguauuccasu | AS1118 | 1228 | AfUfGfGfAfAfUfAfcUfCfUfUfGfGfUfUfAfcfAfUfsgsa | 0.19 | 0.5 | 0.87 | | 0.303 |
| D1119 | S1119 | 137 | AfuGfUfAfcfcAfaGfaGfUfaUfAfuUfcCfasUf | AS1119 | 1229 | aUfgGfaAfuAfcUfcUfuGfgUfuAfcAfusGfsa | 0.14 | 0.55 | 0.89 | | |
| D1120 | S1120 | 138 | AfuGfUfAfcfcAfaGfaGfUfAfUfAfuUfcfCfasUf | AS1120 | 1230 | aUfgGfaAfuAfcUfcUfuGfgUfuAfcAfcAfusGfsa | 0.19 | 0.63 | 0.72 | | |
| D1121 | S1121 | 139 | AfuGfuAfAfccCfaAfGfaGfuAfUfuUfcCfasUf | AS1121 | 1231 | aUfgGfaAfuAfcUfcUfuGfgUfuGfccausGfsa | 0.14 | 0.61 | 0.91 | | |
| D1122 | S1122 | 140 | AfuGfUfAfCfcAfaGfaGfAfUfAfUfuUfcCfasUf | AS1122 | 1232 | aUfgGfaAfuAfcUfcUfuGfgUfuAfcAfusGfsa | 0.14 | 0.54 | 0.95 | | |
| D1123 | S1123 | 141 | auGfUfAfCfcAfaGfaGfUfAfUfAfuUfcCfasUf | AS1123 | 1233 | aUfgGfaAfuAfcUfcUfuGfguuAfcAfUfUfsGfsa | 0.13 | 0.61 | 0.97 | | |
| D1124 | S1124 | 142 | AfuGfUfAfcfcAfaGfaGfaGfUfAfUfAfUfUfcCfasUf | AS1124 | 1234 | aUfgGfaauAfcUfcUfuGfgUfuAfcAfusGfsa | 0.14 | 0.56 | 0.94 | | |
| D1125 | S1125 | 143 | AfuGfUfAfcfcaaGfaGfaGfaAfuccCfasUf | AS1125 | 1235 | aUfgGfaAfuAfcUfAfuCfCfuGfgUfuAfcAfusGfsa | 0.21 | 0.74 | 0.95 | | |
| D1126 | S1126 | 144 | AfuUfGfUfAfCfcAfaGfaGfAfUfuUfcCfasUf | AS1126 | 1236 | aUfgGfaAfuAfcUfcUfuGfgUfuAfcausGfsa | 0.2 | 0.69 | 0.91 | | |
| D1127 | S1127 | 145 | AfuguAfAfcfcAfaGfaGfaGfUfAfuUfcCfasUf | AS1127 | 1237 | aUfgGfaAfuAfcUfcUfuGfguuAfcAfusGfsa | 0.17 | 0.7 | 0.96 | | |
| D1128 | S1128 | 146 | AfuUfGfUfAfcfcAfaGfaGfaGfUfAfuUfcCfasUf | AS1128 | 1238 | aUfgGfaAfuAfcUfcUfuGfgUfuAfcausGfsa | 0.19 | 0.62 | 0.85 | | |
| D1129 | S1129 | 147 | AfuGfUfAfCfcAfaGfaGfaAfuUfcCfCfasUf | AS1129 | 1239 | aUfggaAfuAfcUfcUfuGfgUfuAfcAfusGfsa | 0.23 | 0.76 | 0.98 | | |
| D1130 | S1130 | 148 | AfuGfUfAfcCfcAfaGfaGfAfaAfuUfcCfasUf | AS1130 | 1240 | aUfgGfaAfuAfcUfcUfuGfgUfuAfcAfusGfsa | 0.21 | 0.64 | 0.9 | | |
| D1131 | S1131 | 149 | AfuGfUfAfCfcaaGfaGfaGfaGfuAfuUfcCfasUf | AS1131 | 1241 | aUfgGfaAfuAfcUfcUfuGfguuAfcAfusGfsa | 0.17 | 0.7 | 1.01 | | |
| D1132 | S1132 | 150 | AfuGfUfAfcfcAfaGfaGfaGfaAfuUfcCfasUf | AS1132 | 1242 | aUfgGfaAfuAfcUfcUfuGfgUfuacAfusGfsa | 0.17 | 0.58 | 0.87 | | |
| D1133 | S1133 | 151 | AfuGfUfAfcfcAfaGfaGfAfuAfuUfcCfAfsUf | AS1133 | 1243 | augGfaAfuAfcUfcUfuGfgUfuAfcAfusGfsa | 0.33 | 0.89 | 1.05 | | |

TABLE 1-continued

RNAi Agents and Results of In Vitro Screening

| Duplex ID | S ID | SEQ ID NO: | Sense strand (S) | AS ID | SEQ ID NO: | Antisense strand (AS) | 1 nM | 0.1 nM | 0.01 nM | IC50 (nM) |
|---|---|---|---|---|---|---|---|---|---|---|
| D1134 | S1134 | 152 | AfUfGfuAfaCfcAfaGfaguAfuUfccCfasUf | AS1134 | 1244 | aUfgGfaAfuAfcUfcUfuGfuAfcausGfsa | 0.16 | 0.64 | 0.96 | |
| D1135 | S1135 | 153 | AfUfGfuAfaCfcAfaGfaguAfuUfccCfasUf | AS1135 | 1245 | aUfgGfaAfuAfcUfcUfuGfuAfuaCfsa | 0.12 | 0.53 | 0.96 | |
| D1136 | S1136 | 154 | AfoGfuAfAfCfcAfaGfagaGfuAfuUfccCfasUf | AS1136 | 1246 | aUfgGfaAfuAfcUfcUfuGfguuAfcAfusGfsa | 0.16 | 0.58 | 0.98 | |
| D1137 | S1137 | 155 | AfUfGfuAfaCfcAfaGfaGfuAfuUfccCfasUf | AS1137 | 1247 | aUfgGfaAfuAfcUfcUfuGfguuAfcAfusGfsa | 0.16 | 0.6 | 0.91 | |
| D1138 | S1138 | 156 | AfUfGfuAfaCfcAfaGfaGfuAfuUfccCfasUf | AS1138 | 1248 | aUfgGfaAfuAfcUfcUfuGfuAfcAfusGfsAf | 0.1 | 0.54 | 0.91 | |
| D1139 | S1139 | 157 | AfUfGfUfAfaCfcAfaGfaGfuAfuUfccCfasUf | AS1139 | 1249 | aUfgGfaAfuAfcUfcUfuGfuAfcausGfsa | 0.24 | 0.68 | 0.98 | |
| D1140 | S1140 | 158 | AfUfGfUfAfaCfcAfaGfaguAfuUfccCfasUf | AS1140 | 1250 | aUfgGfaAfuAfcUfcUfuGfuAfcAfusGfsa | 0.13 | 0.75 | 0.9 | |
| D1141 | S1141 | 159 | AfUfGfuAfaCfcAfaGfaguAfuUfccCfasUf | AS1141 | 1251 | aUfgGfaAfuAfcUfcUfuGfuAfcAfusGfsa | 0.15 | 0.52 | 1.05 | |
| D1142 | S1142 | 160 | AfuGfuAfaCfcAfaGfaGfaGfuAfuUfccCfasUf | AS1142 | 1252 | aUfgGfaAfuAfcUfcUfuGfuggAfcAfusGfsa | 0.16 | 0.66 | 0.89 | |
| D1143 | S1143 | 161 | auGfuAfaCfcCfaAfgCfaGfaGfuAfuUfccCfasUf | AS1143 | 1253 | aUfgGfaAfuAfcUfcUfuGfuGfuAfUfsGfsa | 0.12 | 0.51 | 0.89 | |
| D1144 | S1144 | 162 | AfUfGfuAfaCfcaaGfaGfaGfuAfuAfuUfccCfasUf | AS1144 | 1254 | aUfgGfaAfuAfcUfcUfuGfuGfuAfcAfusGfsa | 0.25 | 0.71 | 0.95 | |
| D1145 | S1145 | 163 | AfUfUfGfuAfaAfcCfcaaGfaGfuAfuUfccCfasUf | AS1145 | 1255 | aUfgGfaAfuAfcUfcUfuGfuGfuaAfcAfusGfsa | 0.17 | 0.74 | 0.98 | |
| D1146 | S1146 | 164 | AfuguAfaCfcAfaGfaGfuAfuUfccCfasUf | AS1146 | 1256 | aUfgGfaAfuAfcUfcUfuGfuAfCfAfusGfsa | 0.11 | 0.51 | 0.86 | |
| D1147 | S1147 | 165 | AfUfGfuAfaCfcAfaGfaGfaGfuAfuUfccCfasUf | AS1147 | 1257 | aUfGfGfaAfuAfcUfcUfuGfcUfuGfuGfuAfcAfusGfsa | 0.1 | 0.52 | 0.83 | |
| D1148 | S1148 | 166 | AfUfGfuAfuaCfcAfaGfaGfaGfuAfuUfccCfasUf | AS1148 | 1258 | aUfgGfaAfuAfcUfcUfuGfuGfuAfcausGfsa | 0.14 | 0.63 | 0.98 | |
| D1149 | S1149 | 167 | AfUfGfuAfAfCfcAfaGfaGfuAfuAfuUfccCfasUf | AS1149 | 1259 | aUfgGfaAfAfuAfcUfcUfuGfguuAfcAfusGfsa | 0.13 | 0.58 | 0.88 | |
| D1150 | S1150 | 168 | AfuGfuaaCffcAfaGfaGfuAfuAfuUfcCfasUf | AS1150 | 1260 | aUfgGfaAfuAfcUfcUfuGfuAfcAfusGfsa | 0.15 | 0.62 | 0.94 | |
| D1151 | S1151 | 169 | AfuGfuaaCfcAfaGfaGfuAfuUfccCfasUf | AS1151 | 1261 | aUfgGfaAfuAfcUfcUfuGfuAfcausGfsa | 0.18 | 0.73 | 0.94 | |
| D1152 | S1152 | 170 | auGfUfAfaCfcAfaGfaGfuAfuUfccCfasUf | AS1152 | 1262 | aUfgGfaAfuAfcUfcUfuGfguuAfcAfusGfsa | 0.13 | 0.53 | 0.97 | |
| D1153 | S1153 | 171 | AfUfGfuAfaCfcAfaGfaGfuAfuUfccCfasUf | AS1153 | 1263 | aUfgGfaAfuAfcUfcUfuGfguuAfcAfusGfsa | 0.13 | 0.53 | 0.98 | |
| D1154 | S1154 | 172 | AfuGfAfuUfuCfaUfgUfaAfcCfaAfgsAf | AS1154 | 1264 | uCfuUfgGfuuAfacCfaUfgAfaAfuCfcCfasUfsc | 0.09 | 0.5 | 0.78 | |
| D1155 | S1155 | 173 | UfgGfAfuuuCfaUfgUfAfAfcCfaAfgsAf | AS1155 | 1265 | uCfuUfgGfuuaCfaUfgAfaAfuCfcCfasUfsc | 0.13 | 0.62 | 0.89 | |
| D1156 | S1156 | 174 | UfgGfGfAfuuuCfaUfgUfuAfAfcCfaAfgsAf | AS1156 | 1266 | uCfuUfgGfuuacaUfgAfAfuCfcCfasUfsc | 0.12 | 0.65 | 0.85 | |

TABLE 1-continued

RNAi Agents and Results of In Vitro Screening

| Duplex ID | s ID | SEQ ID NO: | Sense strand (S) | AS ID | SEQ ID NO: | Antisense strand (AS) | % of mRNA remained conc. of siRNA 1 nM | 0.1 nM | 0.01 nM | IC50 (nM) |
|---|---|---|---|---|---|---|---|---|---|---|
| D1157 | S1157 | 175 | UfgGfgAfuUfucCfaUfgUfAfAfccCfaAfgsAf | AS1157 | 1267 | uCfuUfgGfuuaCfaUfgAfaAfuCfcCfasUfsc | 0.11 | 0.54 | 0.85 | |
| D1158 | S1158 | 176 | UfgGfgAfuuuCfaUfgUfAfAfccCfaAfgsAf | AS1158 | 1268 | uCfuUfgGfuuaCfaUfgAfAfAfuCfcCfasUfsc | 0.13 | 0.53 | 0.8 | |
| D1159 | S1159 | 177 | UfGfggAfuUfuCfaUfuGfAfAfccCfAfgsAf | AS1159 | 1269 | uCfuuGfGfuuaAfcAfugGaAfauCfCfcasUfsc | 0.59 | 0.89 | 0.81 | |
| D1160 | S1160 | 178 | UfgGfgAfuuuCfaUfgUfAfAfccCfaAfgsAf | AS1160 | 1270 | uCfuUfgGfuuaCfaUfgAfAfAfuCfcCfasUfsc | 0.16 | 0.72 | 0.9 | |
| D1161 | S1161 | 179 | UfgGfgAfuUfucaUfGfUfaAfcCfaAfcUfcCfasUf | AS1161 | 1271 | uCfuUfgGfuUfacaUfGfAfaAfuCfcCfasUfsc | 0.27 | 0.69 | 0.86 | |
| D1162 | S1162 | 180 | AfuGfuAfaCfcaaGfaGfuFfAfAfcUfcCfasUf | AS1162 | 1272 | aUfgGfaAfuacUfcUfUfgFfuAfcAfusGfsa | 0.12 | 0.6 | 0.95 | |
| D1163 | S1163 | 181 | AfuGfuAfaccAfGfaGfuAfuFfAfAfUfcCfasUf | AS1163 | 1273 | aUfgGfaauAfcUfcUfuGfuUfaAfcAfusGfsa | 0.05 | 0.56 | 1.02 | |
| D1164 | S1164 | 182 | AfuGfuAfaCfcAfagaGfuFfAfAfUfcCfasUf | AS1164 | 1274 | aUfgGfaAfaacUfcUfcUfuGfuUfaAfcAfusGfsa | 0.13 | 0.55 | 1 | |
| D1165 | S1165 | 183 | AfuGfuAfaCfcaaGfaGfuAfAfFfUfcCfasUf | AS1165 | 1275 | aUfgGfaAfaAfcUfcUfuGfuUfaAfcAfusGfsa | 0.09 | 0.6 | 0.97 | |
| D1166 | S1166 | 184 | AfuguAfaCfCfaAfagaGfaGfuAfGfuAfUfcCfasUf | AS1166 | 1276 | aUfgGfaAfaAfcUfcUfuGfuUfggUfgFfuAfcAfusGfsa | 0.15 | 0.59 | 0.91 | |
| D1167 | S1167 | 185 | AfuGfuAfaCfcAfaGfuFfAfAfUfcCfasUf | AS1167 | 1277 | aUfgGfaAfaAfcUfcUfuFfuFfuAfcAfusGfsa | 0.11 | 0.59 | 1 | |
| D1168 | S1168 | 186 | AfuGfuAfaCfcFfCfAfagaGfuAfuFfAfAfUfcCfasUf | AS1168 | 1278 | aUfgGfaAfaAfcUfcUfcUfugGfuFfuAfcAfusGfsa | 0.13 | 0.57 | 0.94 | |
| D1169 | S1169 | 187 | auGfuAfaCfcCfAfagaGfaGfuAfuFfAfAfUfcCfasUf | AS1169 | 1279 | aUfgGfaAfaAfcUfcUfuGfuUfaAfcAfusGfsa | 0.08 | 0.5 | 0.9 | |
| D1170 | S1170 | 188 | AfuguAfaCfcCfAfCfagaGfaGfuAfuFfAfAfUfcCfasUf | AS1170 | 1280 | aUfgGfaAfaAfcUfcUfuGfuUfaAfcAfusGfsa | 0.06 | 0.53 | 0.91 | |
| D1171 | S1171 | 189 | auGfuAfaCfcAfCfAfagaGfaGfuAfuFfAfAfUfcCfasUf | AS1171 | 1281 | aUfgGfgaAfaAfcUfcUfuGfuUfaAfcAfusGfsa | 0.07 | 0.56 | 0.89 | |
| D1172 | S1172 | 190 | AfuGfuAfaCfcAfcAfgaGfaGfuAfuFfAfAfUfcCfasUf | AS1172 | 1282 | aUfgGfaAfaAfcUfcUfcUfuggUfuFfuAfcAfusGfsa | 0.13 | 0.59 | 0.98 | |
| D1173 | S1173 | 191 | AfuGfuAfaCfcAfaCfagaGfaGfuAfuFfAfAfUfcCfasUf | AS1173 | 1283 | aUfgGfaAfaAfcUfaUfcucUfuGfuUfaAfcAfusGfsa | 0.2 | 0.65 | 1.03 | |
| D1174 | S1174 | 192 | AfuGfuAfaCfcAfaCfcAfagaGfaGfuAfuFfAfAfUfUfcCfasUf | AS1174 | 1284 | aUfgGfaAfaAfcUfcUfuGfuUfaAfcAfusGfsa | 0.07 | 0.51 | 0.95 | |
| D1175 | S1175 | 193 | AfuGfuAfaCfcAfaGfaGfuAfuFfAfAfUfUfcCfCfasUf | AS1175 | 1285 | aUfgGfgaAfaAfcUfcUfuGfuUfaAfcAfusGfsa | 0.2 | 0.53 | 0.76 | |
| D1176 | S1176 | 194 | auGfuAfaCfcAfcCfaAfagaGfaGfuAfuFfAfuucCfasUf | AS1176 | 1286 | augGfaAfaAfcUfcUfuGfuUfaAfcAfusGfsa | 0.74 | 0.98 | 0.81 | |
| D1177 | S1177 | 195 | AfuGfuAfaCfcFfcAfagaGfaGfuAfuFfuucCfAfsUf | AS1177 | 1287 | augGfaAfAfAfcUfcUfuGfuGfuUfaAfcAfusGfsa | 0.43 | 0.64 | 0.88 | |
| D1178 | S1178 | 196 | auguaccAfaGfaGfuAfuUfcCfasUf | AS1178 | 1288 | aUfgGfaAfaAfcUfcUfuGfuUfaAfcAfusGfsa | 0.17 | 0.49 | 0.81 | |

TABLE 1-continued

RNAi Agents and Results of In Vitro Screening

| Duplex ID | SEQ ID NO: | S ID | Sense strand (S) | SEQ ID NO: | AS ID | Antisense strand (AS) | % of mRNA remained conc. of siRNA | | | IC50 (nM) |
|---|---|---|---|---|---|---|---|---|---|---|
| | | | | | | | 1 nM | 0.1 nM | 0.01 nM | |
| D1179 | 197 | S1179 | AfuGfuaaCfcAfaGfaGfuAfuUfCfCfasUf | 1289 | AS1179 | aUfggaAfaAfuCfcUfuGfgUfuAfcAfusGfsa | 0.22 | 0.65 | 0.73 | |
| D1180 | 198 | S1180 | AfuguAfaCfcAfaGfaGfuAfuUfcCfAfsUf | 1290 | AS1180 | augGfaAfuAfcUfcUfuGfgUfuAfcAfuFfsGfsa | 0.6 | 1.09 | 0.8 | |
| D1181 | 199 | S1181 | auGfuAfaCfcAfaGfaGfuAfuUfccasu | 1291 | AS1181 | aUfggaAfaAfcUfcUfuGfgUfuAfcAfusGfsa | 0.3 | 0.78 | 0.78 | |
| D1182 | 200 | S1182 | auguaaccaaGfaGfuAfuUfcCfasUf | 1292 | AS1182 | aUfggaAfaAfcUfuGfgUfuAfcAfusGfsa | 0.35 | 0.73 | 0.84 | |
| D1183 | 201 | S1183 | AfuGfuAfaccAfaGfaGfuAfuUfCfCfasUf | 1293 | AS1183 | aUfggaAfaAfuCfcUfuGfgUfuAfcAfusGfsa | 0.19 | 0.6 | 0.94 | |
| D1184 | 202 | S1184 | AfuGfuaaCfcAfaGfaGfuAfuUfcCfAfsUf | 1294 | AS1184 | augGfaAfuAfcUfcUfuGfgUfuAfcAfusGfsa | 0.61 | 1.08 | 0.8 | |
| D1185 | 203 | S1185 | auGfuAfaCfcAfaGfaGfuAfuUfcCfasUf | 1295 | AS1185 | aUfgGfaAfuAfcUfcUfuGfgUfuAfcAfusGfsa | 0.16 | 0.52 | 0.72 | |
| D1186 | 204 | S1186 | auguaaccaagaGfuAfuUfcCfasUf | 1296 | AS1186 | aUfgGfaAfuAfcUfcUfuGfgUfuAfcAfusGfsa | 0.2 | 0.53 | 0.74 | |
| D1187 | 205 | S1187 | AfuGfuAfaCfcaaGfaGfuAfuUfCfCfasUf | 1297 | AS1187 | aUfgGfaAfuAfcUfcUfuFfgUfuAfcAfusGfsa | 0.34 | 0.66 | 0.85 | |
| D1188 | 206 | S1188 | AfuGfuAfaccAfaGfaGfuAfuUfcCfAfsUf | 1298 | AS1188 | augGfaAfuAfcUfuGfgUfuAfcAfusGfsa | 0.61 | 0.98 | 1.02 | |
| D1189 | 207 | S1189 | AfuGfuAfaCfcAfaGfaGfuAfuUfccasu | 1299 | AS1189 | aUfgGfaAfuAfcUfcUfuGfgUfuAfcAfusGfsa | 0.3 | 0.73 | 0.85 | |
| D1190 | 208 | S1190 | auguaaccaagaguauuccasu | 1300 | AS1190 | aUfgGfaAfuAfcUfcUfuGfgUfuAfcAfusGfsa | 0.28 | 0.69 | 0.78 | |
| D1191 | 209 | S1191 | AfuGfuAfaCfcAfcAfaGfaGfuAfuUfcCfasUf | 1301 | AS1191 | aUfgGfaAfuAfcUfcUfugdGudTadCadTsgsa | 0.33 | 0.88 | 0.64 | |
| D1192 | 210 | S1192 | AfuGfuAfaCfcAfcaaGfaGfuAfuUfcCfCfasUf | 1302 | AS1192 | aUfgGfaAfuAfcUfcUfuGfgUfuAfcAfusGfsa | 0.31 | 0.64 | 0.83 | |
| D1193 | 211 | S1193 | AfuGfuAfaCfcAfcaaGfaGfuAfuUfcCfAfsUf | 1303 | AS1193 | augGfaAfuAfcUfcUfuGfgUfuAfcAfusGfsa | 0.64 | 0.82 | 0.92 | |
| D1194 | 212 | S1194 | AfuGfuAfaCfcAfcAfaGfaGfuAfuUfcCfCfasUf | 1304 | AS1194 | aUfgGfaAfuAfcUfcUfuGfgUfuAfcAfusGfsa | 0.21 | 0.62 | 0.77 | |
| D1195 | 213 | S1195 | AfuGfuAfaCfcAfcAfaGfaGfuAfuUfcCfCfasUf | 1305 | AS1195 | aUfgGfaAfuAfcUfcUfuGfuFfuAfcAfusGfsa | 0.17 | 0.7 | 0.95 | |
| D1196 | 214 | S1196 | AfuGfuAfaCfcAfcAfaGfaguAfuUfcCfCfasUf | 1306 | AS1196 | augGfaAfuAfcUfcUfuGfgUfuAfcAfusGfsa | 0.19 | 0.71 | 0.65 | |
| D1197 | 215 | S1197 | AfuGfuAfaCfcAfcAfcaaGfaGfuAfuUfcCfAfsUf | 1307 | AS1197 | augGfaAfuAfcUfcUfuGfgUfuAfcAfusGfsa | 0.64 | 0.82 | 0.93 | |
| D1198 | 216 | S1198 | auGfuAfaCfcAfcAfaGfuAfuUfccasu | 1308 | AS1198 | aUfgGfaAfuAfcUfcUfuGfgUfuAfcAfusGfsa | 0.19 | 0.65 | 0.72 | |
| D1199 | 217 | S1199 | AfuGfuAfaCfcAfaGfaGfuauUfcCfAfsUf | 1309 | AS1199 | aUfggaAfaAfuCfcUfuGfgUfuAfcAfusGfsa | 0.15 | 0.52 | 0.64 | |
| D1200 | 218 | S1200 | AfuGfuaaCfcAfaGfaGfuAfuUfcCfAfsUf | 1310 | AS1200 | augGfaAfuAfcUfuAfuUfgGfuUfaAfcAfusGfsa | 0.48 | 0.74 | 0.92 | |
| D1201 | 219 | S1201 | auguAfaCfcAfaGfaGfuAfuUfcCfasu | 1311 | AS1201 | aUfgGfaAfuAfcUfcUfuGfgUfuAfcAfusGfsa | 0.17 | 0.71 | 0.77 | |

TABLE 1-continued

RNAi Agents and Results of In Vitro Screening

| Duplex ID | SEQ ID NO: Sense strand (S) | S ID | SEQ ID NO: Antisense strand (AS) | AS ID | % of mRNA remained conc. of siRNA | | | IC50 (nM) |
|---|---|---|---|---|---|---|---|---|
| | | | | | 1 nM | 0.1 nM | 0.01 nM | |
| D1202 | AfuGfuAfcCfcAfaGfaGfuauUfcCfAfsUf | S1202 | augGfaAfuAfcUfcUfcGfgUfuAfcAfusGfsa | AS1202 | 0.43 | 0.69 | 0.85 | |
| D1203 | auguaaCfcAfaGfaGfuAfuUfuUfcCfasUf | S1203 | aUfgGfaAfuAfcUfcUfgUfuAfcAfusGfsa | AS1203 | 0.14 | 0.61 | 0.76 | |
| D1204 | AfuGfuAfaCfcAfaGfaGfuAfuUfuUfcCfasUf | S1204 | aTdGgGfaAfudAdCfUfcUfgUfuAfcAfusGfsa | AS1204 | 0.16 | 0.56 | 0.89 | |
| D1205 | AfuGfuAfaCfcAfaGfaGfdAdTdTcCfasUf | S1205 | aUfgGfdAdAdGfaAfuAfcUfcUfgUfuAfcAfusGfsa | AS1205 | 0.13 | 0.57 | 0.9 | |
| D1206 | AfuGfuAfaCfcAfaGfaGfuAfuUfuCfCfasUf | S1206 | aTdGdGdGfaAfuAfcUfcUfgUfuAfcAfusGfsa | AS1206 | 0.29 | 0.73 | 0.89 | |
| D1207 | AfuGfuAfaCfcAfaGfaGfuAfuUfuUfcCfasUf | S1207 | aTdGgGfaAfuAfdCdTcUfcUfgUfuAfcAfusGfsa | AS1207 | 0.16 | 0.56 | 0.78 | |
| D1208 | AfuGfuAfaCfcAfaGfaGfuAfuUfuUfcCfasUf | S1208 | aUfGdGdGdAdAuAfcUfcUfgUfuAfcAfusGfsa | AS1208 | 0.22 | 0.67 | 0.89 | |
| D1209 | AfuguAfaccAfaGfaGfuAfuUfuUfcCfasUf | S1209 | aUfgGfaAfuAfcUfcUfgUfGfUfuAfcAfusGfsa | AS1209 | 0.14 | 0.55 | 0.78 | |
| D1210 | AfuGfuAfaCfcAfaGfaGfuAfuUfuUfcCfasUf | S1210 | aUfgdGdAdAdTafcUfcUfgUfuAfcAfusGfsa | AS1210 | 0.14 | 0.5 | 0.84 | |
| D1211 | AfuGfuAfaCfcAfaGfAfgUfaUfuCfcAfsu | S1211 | aUfgGfadAdTdAdCfUfcUfgUfuAfcAfusGfsa | AS1211 | 0.14 | 0.59 | 0.72 | |
| D1212 | auguaaccaaGfaGfuAfuUfcCfasUf | S1212 | aUfgGfaAfuAfcUfcUfgdGudTadCadTsgsa | AS1212 | 0.21 | 0.74 | 0.77 | |
| D1213 | AfuGfuAfaCfcAfaGfaGfuAfudTdCdCdAsUf | S1213 | adTdGdGdGdAAfuAfcUfcUfgUfuAfcAfusGfsa | AS1213 | 0.15 | 0.53 | 0.91 | |
| D1214 | aUfgUfaAfcCfAfgAfgfaUfuCfcAfsu | S1214 | aUfgGfaAfuAfcUfcUfCfuuGfUfuAfcAfusGfsa | AS1214 | 0.12 | 0.71 | 0.87 | |
| D1215 | AfuGfuAfaCfcAfaGfaGfuAfdTdTdcCasUf | S1215 | aUfGdGdGdAdAnAfcUfcUfgUfuAfcAfusGfsa | AS1215 | 0.18 | 0.67 | 0.97 | |
| D1216 | AfuGfuAfaccaagaguAfuUfcCfasUf | S1216 | aUfgGfaAfuacucuuggUfuAfcAfusgsa | AS1216 | 0.36 | 0.87 | 1.07 | |
| D1217 | AfuGfuAfaccaagaAfuUfcCfasUf | S1217 | aUfgGfaAfuAfcUfcUfUfUfgUfuAfcAfusgsa | AS1217 | 0.37 | 0.73 | 1.03 | |
| D1218 | AfuGfuAfaccaagaAfuUfcCfasUf | S1218 | aUfgGfaAfuAfcUfaUfuGfGfuuAfcAfusGfsa | AS1218 | 0.23 | 0.42 | 0.84 | |
| D1219 | AfuGfuAfaccaagaAfuUfcCfasUf | S1219 | aUfgGfaAfuaCfUfcUfUfgUfuuAfcAfusgsa | AS1219 | 0.43 | 0.71 | 1.03 | |
| D1220 | AfuGfuAfaccaagaAfuUfcCfasUf | S1220 | aUfgGfaAfuAfcUfcUfUfgUfuGfGfuuAfcAfusgsa | AS1220 | 0.37 | 0.63 | 0.99 | |
| D1221 | AfuGfuAfaccaagaAfuUfcCfasUf | S1221 | aUfgGfaAfuAfcUfcUfUfgUfuGfGfuuAfacAfusgsa | AS1221 | 0.29 | 0.84 | 0.88 | |
| D1222 | AfuGfuAfaccaagaAfuUfcCfasUf | S1222 | aUfgGfaAfuacfuUfgGfuuAfcAfusgsa | AS1222 | 0.31 | 0.8 | 0.99 | |
| D1223 | auGfuAfAfcAfgAfaGfaUfaGfCfUfcCfasUf | S1223 | aUfgGfaaUfaCfUfcUfgGfUfuuAfcAfAfsgsa | AS1223 | 0.09 | 0.52 | 0.82 | |

TABLE 1-continued

RNAi Agents and Results of In Vitro Screening

| Duplex ID | S ID | SEQ ID NO: Sense strand (S) | AS ID | SEQ ID NO: Antisense strand (AS) | % of mRNA remained conc. of siRNA | | | IC50 (nM) |
|---|---|---|---|---|---|---|---|---|
| | | | | | 1 nM | 0.1 nM | 0.01 nM | |
| D1224 | S1224 | 242 AfuGfuAfaccaagaguAfuUfcCfasUf | AS1224 | 1334 aAfUfgGfaAfuaCfudCudTgdGfuuAfcAfusgsa | 0.22 | 0.79 | 1 | |
| D1225 | S1225 | 243 auGfuaAfcCfagAfguAfuuCfasUf | AS1225 | 1335 aUfGfgAfAfuAfCfuCfUfuGfGfuUfAfcAfUfsGfsa | 0.31 | 0.76 | 0.84 | |
| D1226 | S1226 | 244 AfuGfuAfaccaagaguAfuUfcCfasUf | AS1226 | 1336 aUfgGfaAfuAfAfuadCfUfuGfGfuuAfcAfusgsa | 0.26 | 0.64 | 0.87 | |
| D1227 | S1227 | 245 augUfaacCfaagAfguaUfuccAfsu | AS1227 | 1337 aUfgGfaAfuAfAfcUfuCfUfUfgGfUfuAfCfAfUfsGfsa | 0.33 | 0.79 | 0.81 | |
| D1228 | S1228 | 246 AfuGfuAfacCfcAfaGfaGfuAfuUfcCfasUf | AS1228 | 1338 aUfgGfaAfuAfuAfcUfuCfUfuGfUfuAfcAfGfsa | 0.464 | 0.932 | 0.978 | |
| D1229 | S1229 | 247 AfuGfuAfacCfcAfaGfaGfuAfuUfcCfasUf | AS1229 | 1339 aUfgGfaAfuAfuAfcUfuCfuGfuGfUfuAfcAfusGfsa | 0.453 | 1.047 | 1.178 | |
| D1230 | S1230 | 248 AfuGfuAfacCfcAfaGfaGfuAfuUfcCfasUf | AS1230 | 1340 aUfgGfaAfuAfuAfcUfuGfuGfuuAfcAfUfsGfsa | 0.831 | 0.967 | 1.151 | |
| D1231 | S1231 | 249 auGfuAfAfcCfaAfaGfaGfuAfuUfcCfasu | AS1231 | 1341 AfuUfgGfaAfuAfuAfcUfUfuGfuGfuuAfcAfUfsGfsa | 0.09 | 0.5 | 1.07 | |
| D1232 | S1232 | 250 AfuGfuAfacCfcAfaGfaGfuAfuUfcCfasu | AS1232 | 1342 AfUfgGfaAfuAfAfcUfuCfUfuGfUfuAfcAfUfsGfsa | 0.11 | 0.54 | 1.1 | |
| D1233 | S1233 | 251 AfuGfuAfacCfcAfaGfaGfuAfuUfcCfCfasu | AS1233 | 1343 AfUfggaAfuAfuAfcUfuGfUfuAfcAfUfsGfsa | 0.19 | 0.61 | 0.74 | |
| D1234 | S1234 | 252 aUfgUfaAfcCfaAfgAfgUfaUfuCfcAfsu | AS1234 | 1344 AfuUfgGfaAfuAfCfuCfuCfuUfgGfuUfaCfaUfsgsAf | 0.22 | 0.61 | 0.98 | |
| D1235 | S1235 | 253 aUfgUfaAfcCfaAfgAfgUfaUfuCfcAfsu | AS1235 | 1345 AfuUfgGfaAfuAfCfuCfuCfuUfgGfuUfaCfaUfsgsAf | 0.27 | 0.69 | 0.92 | |
| D1236 | S1236 | 254 AfuGfuAfcCfcAfaGfaGfuAfuUfcCfasUf | AS1236 | 1346 AfuUfgGfaAfuAfCfuCfuCfuUfgGfuUfaCfaUfsgsAf | 0.54 | 1.08 | 0.8 | |
| D1237 | S1237 | 255 augUfaAfcCfaAfgAfguaUfuCfcasu | AS1237 | 1347 AfUfUfgGfaAfuUfAfCfuCfuUfGfGfuuGfuaCfAfUfsgsa | 0.29 | 0.61 | 0.79 | |
| D1238 | S1238 | 256 AfuGfuAfAfccaAfgAfguaUfuCfcasu | AS1238 | 1348 AfUfgGfgAfaUfAfAfcUfuCfucUfuGfGfuuGfuAfcAfusgsa | 0.31 | 0.6 | 0.88 | |
| D1239 | S1239 | 257 AfuGfuAfAfcCfaAfgAfgUfuAfuUfcCfasUf | AS1239 | 1349 dAuDGGGdAauAfcUfcUfuGfuGfuUfAfcAfusGfsa | 0.2 | 0.67 | 0.85 | |
| D1240 | S1240 | 258 AfuGfuAfAfcCfaAfgAfgUfuAfuUfcCfasUf | AS1240 | 1350 dAuDGGdAauAfcUfcUfuGfuGfuUfAfcAfusGfsa | 0.23 | 0.58 | 0.68 | |
| D1241 | S1241 | 259 AfuGfuAfAfcCfaAfgAfgUfuAfuUfcCfasUf | AS1241 | 1351 dAuDGGdAadAAfcUfcUfuGfuGfuUfAfcAfusGfsa | 0.25 | 0.65 | 0.78 | |
| D1242 | S1242 | 260 AfuGfuAfAfcCfaAfgAfgUfuAfuUfcCfasUf | AS1242 | 1352 dAuDGGdAadTAfcUfcUfuGfuGfuUfAfcAfusGfsa | 0.18 | 0.64 | 0.84 | |
| D1243 | S1243 | 261 AfuGfuAfAfcCfaAfgAfgUfuAfuUfcCfasUf | AS1243 | 1353 dAuDGGdAAAfUfcUfuGfuGfuUfAfcAfusGfsa | 0.19 | 0.72 | 0.87 | |
| D1244 | S1244 | 262 AfuGfuAfAfcCfaAfgAfgUfuAfuUfcCfasUf | AS1244 | 1354 dAuDGGdAadTAfdCUfuGfuGfuUfAfcAfusGfsa | 0.16 | 0.55 | 0.8 | |
| D1245 | S1245 | 263 AfuGfuAfAfcCfaAfgAfgUfuAfuUfcCfasUf | AS1245 | 1355 dAuDGGGdAAAuUfcUfuGfuGfuUfAfcAfusGfsa | 0.22 | 0.51 | 0.9 | |
| D1246 | S1246 | 264 AfuGfuAfAfcCfaAfgAfgUfuAfuUfcCfasUf | AS1246 | 1356 dAuDGGdAadTAfcUfcUfuGfuGfuUfAfcAfusGfsa | 0.27 | 0.78 | 0.66 | |

TABLE 1-continued

RNAi Agents and Results of In Vitro Screening

| Duplex ID | S ID | SEQ ID NO: | Sense strand (S) | AS ID | SEQ ID NO: | Antisense strand (AS) | % of mRNA remained conc. of siRNA 1 nM | 0.1 nM | 0.01 nM | IC50 (nM) |
|---|---|---|---|---|---|---|---|---|---|---|
| D1247 | S1247 | 265 | AfuGfuAfcCfcAfaGfaGfuAfuUfcCfasUf | AS1247 | 1357 | dAdTdGdGaAfuAfcUfcUfugGfuUfuAfcAfusGfsa | 0.16 | 0.57 | 0.97 | |
| D1248 | S1248 | 266 | AfacaAfuguUfcUfuGfdCudCudAudAsa | AS1248 | 1358 | dTUdAudAgdAGfcAfaGfaAfcAfcUfgUfusUfsu | 0.06 | 0.09 | 0.36 | 0.0047 |
| D1249 | S1249 | 267 | AfacTaGfuGfuUfcUfuGfCfUfcUfaUfasa | AS1249 | 1359 | UfUfaUfaGfagcAfaGfaAfcAfcUfgUfusUfsu | 0.06 | 0.10 | 0.47 | 0.005 |
| D1250 | S1250 | 268 | AfacTaGfuGfuUfcUfuGfugcUfcUfAfUfasAf | AS1250 | 1360 | uUfauaGfaGfcAfaGfaAfcAfcUfgUfusUfsu | 0.07 | 0.14 | 0.55 | 0.005 |
| D1251 | S1251 | 269 | AfacTaGfuGfuUfcUfuGfcucUfAfUfasAf | AS1251 | 1361 | uUfauaGfaGfcAfaGfcAfcUfgUfusUfsu | 0.07 | 0.14 | 0.49 | 0.006 |
| D1252 | S1252 | 270 | cAGuGuucuuGcucuAuAAdTdT | AS1252 | 1362 | UuAuAGAGcAAGAAcACUGdTdT | | | | 0.006 |
| D1253 | S1253 | 271 | AfacTaGfuGfuUfcUfugcUfcUfaUfasAf | AS1253 | 1363 | uUfagaGfcAfaGfcAfaGfaAfcAfcUfgUfusUfsu | 0.05 | 0.12 | 0.43 | 0.006 |
| D1254 | S1254 | 272 | AfacTaGfuGfuUfcUfuGfcUfcUfaUfasa | AS1254 | 1364 | UfUfaUfaGfagGfcAfagaAfcAfcUfgUfusUfsu | 0.06 | 0.13 | 0.39 | 0.006 |
| D1255 | S1255 | 273 | AfacTaGfuGfuUfcUfuGfcUfuGfcUfaUfasa | AS1255 | 1365 | UfUfaUfaGfagGfcAfaGfaAfcAfcUfgUfusUfsu | 0.08 | 0.17 | 0.48 | 0.007 |
| D1256 | S1256 | 274 | AfacTaGfuGfuUfcUfuGfcUfGfcUfUfasa | AS1256 | 1366 | UfUfaUfaGfaGfcaaGfaAfcAfcUfgUfusUfsu | 0.08 | 0.14 | 0.40 | 0.007 |
| D1257 | S1257 | 275 | AfacTaGfuGfuUfcUfuGfcUfcUfaUfasAf | AS1257 | 1367 | uUfaUfagaGfcAfaGfaAfcAfcUfgUfusUf | 0.07 | 0.12 | 0.40 | 0.007 |
| D1258 | S1258 | 276 | AfacTaGfagaGfuUfcUfuGfcUfcUfaUfasa | AS1258 | 1368 | uUfaUfaGfaGfcAfagaAfcAfcUfgUfusUfsu | 0.08 | 0.13 | 0.41 | 0.007 |
| D1259 | S1259 | 277 | AfacTaGfaGfuGfuUfcUfuGfcUfcUfaUfasAf | AS1259 | 1369 | uUfaUfaGfaGfcAfagaAfcAfugUfgUfusUfsu | 0.05 | 0.11 | 0.35 | 0.008 |
| D1260 | S1260 | 278 | AfacaGfuGfuUfcUfCfUfuGfcUfcUfaUfasAf | AS1260 | 1370 | uUfaUfaGfaGfcAfagaAfcAfcUfgUfusUfsu | 0.06 | 0.12 | 0.40 | 0.008 |
| D1261 | S1261 | 279 | AfacaGfuGfuUfcUfuGfcUfcUfaUfasAf | AS1261 | 1371 | uUfaUfaGfaGfcaaGfaAfcAfcUfgUfusUfsu | 0.06 | 0.13 | 0.42 | 0.008 |
| D1262 | S1262 | 280 | AfacaGfuGfuUfcUfuGfcucUfaUfUfasAf | AS1262 | 1372 | uUfaUfaGfAfgGfcAfaGfaAfcAfcUfgUfusUfsu | 0.06 | 0.13 | 0.37 | 0.008 |
| D1263 | S1263 | 281 | cAGuGuucuuGcucuAuAdTdT | AS1263 | 1373 | UuAuAGAGcAAGAAcACUGdTdT | | | | 0.008 |
| D1264 | S1264 | 282 | AfacTaGfuUfuGfCfUfCfUfaUfauasAf | AS1264 | 1374 | uUfaUfaGfagcAfaGfaAfcAfcUfgUfusUfsu | 0.07 | 0.12 | 0.50 | 0.008 |
| D1265 | S1265 | 283 | AfacaGfuguUfcUfCfUfuGfcUfcUfaUfasAf | AS1265 | 1375 | uUfaUfaGfaGfcAfagaAfcAfcUfgUfusUfsu | 0.12 | 0.13 | 0.48 | 0.009 |
| D1266 | S1266 | 284 | AfacaGfuGfuUfcUfuGfcUfcUfAfUfasAf | AS1266 | 1376 | uUfauaGfaGfcAfaGfaAfcAfcUfgUfusUfsu | 0.07 | 0.15 | 0.51 | 0.009 |
| D1267 | S1267 | 285 | AfacaAfuguUfcUfuGfdCudCudAsa | AS1267 | 1377 | dTuAudAgdAGfcAfagaAfcAfcUfgUfusUfsu | 0.06 | 0.14 | 0.48 | 0.0088 |
| D1268 | S1268 | 286 | AfacTaGfuGfuUfcUfuGfcucUfaUfUfasAf | AS1268 | 1378 | uUfaUfaGfAfGfcAfagaAfcAfcUfgUfusUfsu | 0.05 | 0.09 | 0.35 | 0.009 |

TABLE 1-continued

RNAi Agents and Results of In Vitro Screening

| Duplex ID | s ID | SEQ ID NO: | Sense strand (S) | AS ID | SEQ ID NO: | Antisense strand (AS) | % of mRNA remained conc. of siRNA | | | IC50 (nM) |
|---|---|---|---|---|---|---|---|---|---|---|
| | | | | | | | 1 nM | 0.1 nM | 0.01 nM | |
| D1269 | S1269 | 287 | cAGuGuucuuGcucuAuAAdTdT | AS1269 | 1379 | UuAuAGAGcAAGAAcACUGdTdT | | | | 0.009 |
| D1270 | S1270 | 288 | aaCfaGfuGfuUfcUfuGfcUfcUfaUfasAf | AS1270 | 1380 | uUfaUfagaGfcAfaGfaAfcAfcUfgUfUfsUfsu | 0.07 | 0.14 | 0.49 | 0.009 |
| D1271 | S1271 | 289 | AfaCfaGfuGfuUfcUfuGfcucUfaUfasAf | AS1271 | 1381 | uUfaUfaGfAfGfcAfaGfaAfcacUfgUfsUfsu | 0.06 | 0.10 | 0.36 | 0.009 |
| D1272 | S1272 | 290 | cAGuGuucuuGcucuAuAAdTdT | AS1272 | 1382 | UuAuAGAGcAAGAAcACUGdTdT | | | | 0.009 |
| D1273 | S1273 | 291 | AfaCfaGfuGfGfuUfcUfuGfcUfcUfaUfasAf | AS1273 | 1383 | uUfaUfaGfaGfcAfaGfaAfcacUfgUfsUfsUf | 0.06 | 0.13 | 0.51 | 0.009 |
| D1274 | S1274 | 292 | AfaCfaGfuGfuUfcUfuGfcUfcuaUfasAf | AS1274 | 1384 | uUfaUfAfAfGfaGfcAfagaAfcAfcUfgUfsUfsu | 0.06 | 0.12 | 0.46 | 0.010 |
| D1275 | S1275 | 293 | cAGuGuucuuGcucuAuAAdTdT | AS1275 | 1385 | UuAuAGAGcAAGAAcACUGdTdT | | | | 0.010 |
| D1276 | S1276 | 294 | AfaCfaGfuGfCfuGfuUfcUfcUfauasAf | AS1276 | 1386 | uUfAfaUfagEfaGfcAfagaAfcAfcUfgUfsUfsu | 0.06 | 0.14 | 0.47 | 0.010 |
| D1277 | S1277 | 295 | AfacfaguGfuUfcUfuGfcUfcUfaUfasAf | AS1277 | 1387 | uUfaUfagaGfcAfaGfcAfaAfcAfcUfgUfsUfsu | 0.07 | 0.15 | 0.50 | 0.010 |
| D1278 | S1278 | 296 | AfacaGfuGfuUfcUfufugcUfcUfaUfasAf | AS1278 | 1388 | uUfaUfaGfaGfcAfagaAfcAfcUfgUfsUfsu | 0.06 | 0.13 | 0.43 | 0.010 |
| D1279 | S1279 | 297 | cAGuGuucuuGcucuAuAAdTdT | AS1279 | 1389 | UuAuAGAGcAAGAAcACUGdTdT | | | | 0.010 |
| D1280 | S1280 | 298 | AfaCfaGfuGfuUfcUfuGfcUfcUfaUfasa | AS1280 | 1390 | UfUfUfaUfaGfaGfcAfaGfaAfcAfcUfgUfuususu | 0.06 | 0.14 | 0.45 | 0.010 |
| D1281 | S1281 | 299 | AfaCfaGfuGfuUfcUfuGfcUfcUfaUfasa | AS1281 | 1391 | UfUfaUfaGfaGfcAfaGfcAfaAfcAfcUfgUfsUfsu | 0.07 | 0.18 | 0.46 | 0.011 |
| D1282 | S1282 | 300 | AfaCfaGfuGfuUfcUfuGfcUfcUfaUfasAf | AS1282 | 1392 | uUfaUfagaGfcAfagaGfcAfaAfcAfcUfgUfsUfsu | 0.07 | 0.15 | 0.55 | 0.011 |
| D1283 | S1283 | 301 | AfaCfaGfuGfuUfcUfuGfcucUfaUfaUfasAf | AS1283 | 1393 | uUfaUfaGfcAfaGfcAfaAfcAfcUfgUfsususu | 0.07 | 0.12 | 0.45 | 0.011 |
| D1284 | S1284 | 302 | AfacaGfuUfaUfcUfuGfcUfcUfaUfasAf | AS1284 | 1394 | uUfaUfaGfaGfcAfagEfcAfaAfcAfcUfgUfsUfsu | 0.06 | 0.13 | 0.48 | 0.011 |
| D1285 | S1285 | 303 | AfaCfaGfuGfuUfcUfuGfcucUfaUfasAf | AS1285 | 1395 | uUfaUfaGfaGfcAfaGfaAfcAfcUfguusUfsu | 0.06 | 0.11 | 0.40 | 0.011 |
| D1286 | S1286 | 304 | AfaCfaGfuGfuUfcUfuGfcUfcuaUfasAf | AS1286 | 1396 | uUfaUfagaGfcAfagEfaAfcAfcUfcugUfsUfsu | 0.07 | 0.16 | 0.47 | 0.011 |
| D1287 | S1287 | 305 | AfacCfaGfuGfuUfcUfuGfcugcUfaUfasAf | AS1287 | 1397 | uUfaUfaGfaGfcAfagCfaAfcAfcUfgUfsUfsususu | 0.07 | 0.19 | 0.46 | 0.012 |
| D1288 | S1288 | 306 | AfacCfaGfuGfuUfcUfuGfugcUfcUfaUfasAf | AS1288 | 1398 | uUfaUfagaGfcAfaGfaAfcAfcUfgUfsUfsu | 0.06 | 0.17 | 0.46 | 0.012 |
| D1289 | S1289 | 307 | AfaCfaGfuGfuUfcUfuGfcucUfaUfaUfasAf | AS1289 | 1399 | uUfaUfaGfAfGfcaaGfaAfcAfcUfgUfsUfsu | 0.05 | 0.09 | 0.31 | 0.012 |
| D1290 | S1290 | 308 | AfaCfaGfuGfuUfcUfuGfcUfcUfaUfasa | AS1290 | 1400 | UUfUfaUfaGfaGfcAfaGfaAfcAfGfaAfgUfuusUfsu | 0.06 | 0.16 | 0.49 | 0.013 |
| D1291 | S1291 | 309 | AfaCfaGfuGfuUfCfuGfcUfcUfaUfasAf | AS1291 | 1401 | uUfaUfagaGfcAfagaAfcAfcUfgUfsUfsUf | 0.06 | 0.11 | 0.32 | 0.013 |

TABLE 1-continued

RNAi Agents and Results of In Vitro Screening

| Duplex ID | s ID | SEQ ID NO: | Sense strand (S) | AS ID | SEQ ID NO: | Antisense strand (AS) | % of mRNA remained conc. of siRNA | | | IC50 (nM) |
|---|---|---|---|---|---|---|---|---|---|---|
| | | | | | | | 1 nM | 0.1 nM | 0.01 nM | |
| D1292 | S1292 | 310 | AfacCfaFgfugfuUfcUfugcUfcUfcUfaUfasAf | AS1292 | 1402 | uUfaUfaGfaGfaGfcUfaAfgaAfcAfcugUfusUfsu | 0.06 | 0.14 | 0.44 | 0.013 |
| D1293 | S1293 | 311 | AfacCfaFgfuGfuUfcUfuGfcUfcUfcUfaUfasa | AS1293 | 1403 | UfUfaUfaGfaGfcAfaGfaAfcacUfgUfusUfsu | 0.07 | 0.16 | 0.39 | 0.013 |
| D1294 | S1294 | 312 | AfacCfaFgfuGfuUfcUfuGfcUfcUfcuaUfasAf | AS1294 | 1404 | uUfaUfAfGfaGfcAfaGfaAfcAfcugUfusUfsu | 0.07 | 0.18 | 0.41 | 0.014 |
| D1295 | S1295 | 313 | AfacCfaFgfuGfuUfcUfuGfcUfcUfcuaUfasAf | AS1295 | 1405 | uUfaUfAfUfGfaGfcAfaGfaAfcacUfgUfusUfsu | 0.07 | 0.18 | 0.47 | 0.014 |
| D1296 | S1296 | 314 | adAdCagdTdGuudCdTugdCdTcudAdTasa | AS1296 | 1406 | dTdTaudAdGagdCdAagdAdAcadCdTgudTrsdTsu | 0.12 | 0.21 | 0.68 | 0.0146 |
| D1297 | S1297 | 315 | AfacGfUfGfuUfcUfuGfcUfcUfCfaUfasAf | AS1297 | 1407 | uUfaUfaGfaGfcAfaGfaAfcAfcacUfgUfusUfsu | 0.06 | 0.15 | 0.50 | 0.016 |
| D1298 | S1298 | 316 | AfacGfUfGfuUfcUfuGfcUfcUfCfauasAf | AS1298 | 1408 | uUfAfUfaGfaGfcAfaGfaAfcAfcacUfgUfusUfsu | 0.08 | 0.17 | 0.50 | 0.016 |
| D1299 | S1299 | 317 | AfacCfaguGfuUfcUfuGfcUfcUfCfaUfasAf | AS1299 | 1409 | uUfaUfaGfaGfcAfaGfaAfcAfcacUfgUfususUfsu | 0.07 | 0.16 | 0.50 | 0.018 |
| D1300 | S1300 | 318 | AfacCfaGfuGfuUfcUfuGfcUfcUfCfaUfasAf | AS1300 | 1410 | uUfAfUfaGfaGfaGfcaaGfaAfcAfcUfgUfusUfsu | 0.06 | 0.12 | 0.43 | 0.020 |
| D1301 | S1301 | 319 | AfacCfaGfuGfuUfcUfugcUfcUfcUfaUfasAf | AS1301 | 1411 | uUfaUfaGfaGfcAfaGfaAfcAfcUfgUfusUfsu | 0.07 | 0.17 | 0.45 | 0.021 |
| D1302 | S1302 | 320 | AfacGfaguUfcUfuGfcUfcUfCfaUfasAf | AS1302 | 1412 | uUfaUfaGfaGfcAfaGfcaaGfaAfcAfcUfgUfusUfsu | 0.06 | 0.14 | 0.49 | 0.021 |
| D1303 | S1303 | 321 | AfaAfCfaguGfuUfcUfuGfcUfcUfCfaUfasAf | AS1303 | 1413 | uUfaUfaGfaGfcAfaGfaAfcAfcUfguusUfsu | 0.07 | 0.24 | 0.51 | 0.022 |
| D1304 | S1304 | 322 | AfacCfaGfuGfuuCfuuCfuGfcUfcUfcUfaUfasAf | AS1304 | 1414 | uUfaUfaGfaGfcAfaGfaAfcAfcUfgUfusUfsu | 0.09 | 0.27 | 0.47 | 0.033 |
| D1305 | S1305 | 323 | aadCdAgudGdTucdTdTgcdTdTgcdTdCuadTdAsa | AS1305 | 1415 | udTadTdAgadGdCaadGdAacdAdCugdTdTsusu | 0.19 | 0.36 | 0.86 | 0.045 |
| D1306 | S1306 | 324 | AfacaGfuguUfCfUfuGfdCUfdCUfdAudAsa | AS1306 | 1416 | dTUfdAUfdAGfadGfcAfaGfaAfcAfcUfGfUfusUfsu | 0.08 | 0.22 | 0.61 | |
| D1307 | S1307 | 325 | AfacaGfuguUfCfUfdTGfdCUfdCUfdAudAsa | AS1307 | 1417 | dTUfdAUfdAGfadGfcAfaGfaAfcAfcUfGfUfusUfsu | 0.13 | 0.39 | 0.84 | |
| D1308 | S1308 | 326 | AfacaGfuguUfCfUfdTGfdCUfdCUfdAudAsa | AS1308 | 1418 | dTUfdAUfdAgdAGfaGfcAfaGfaAfcAfgUfusUfsu | 0.09 | 0.13 | 0.48 | |
| D1309 | S1309 | 327 | AfacaGfuguUfCfUfdTGfdCUfdCUfdAudAsa | AS1309 | 1419 | dTUfdAUfdAgdAgdAGfdCAfaGfaAfcAfgUfusUfsu | 0.07 | 0.13 | 0.58 | |
| D1310 | S1310 | 328 | AfacaAfuguUfCfUfdTGfdCUfdCUfdAudAsa | AS1310 | 1420 | dTUfdAUfdAudAgdAGfdCAfaGfaAfcAfgUfusUfsu | 0.07 | 0.14 | 0.55 | |
| D1311 | S1311 | 329 | AfacaAfuguUfCfUfdTGfdCUfdCUfdAdTdAsdA | AS1311 | 1421 | dTdTdAdTaGfaGfcAfaGfaAfcAfcUfgUfusUfsu | 0.10 | 0.30 | 0.66 | |
| D1312 | S1312 | 330 | AfacaGfuguUfCfdCUfdCUfdAudAsa | AS1312 | 1422 | dTUfdAUfdAgdAGfcAfcAfgAfaGfaAfcAfcUfgUfusUfsu | 0.09 | 0.13 | 0.48 | |
| D1313 | S1313 | 331 | AfAfCfaGfuGfuucUfuGfcUfcUfcUfaUfasAf | AS1313 | 1423 | uUfaUfaGfaGfcAfaGfaAfcAfcUfguusUfsu | 0.14 | 0.38 | 0.74 | |

TABLE 1-continued

RNAi Agents and Results of In Vitro Screening

| Duplex ID | S ID | SEQ ID NO: | Sense strand (S) | AS ID | SEQ ID NO: | Antisense strand (AS) | % of mRNA remained conc. of siRNA 1 nM | 0.1 nM | 0.01 nM | IC50 (nM) |
|---|---|---|---|---|---|---|---|---|---|---|
| D1314 | S1314 | 332 | AfAcTaGfuGfuUfcUfcUfcUfaUfaUfasAf | AS1314 | 1424 | uUfaUfaGfaGfaGfcAfaGfaAfcAfcUfgUfusUfsu | 0.07 | 0.19 | 0.54 | |
| D1315 | S1315 | 333 | AfAcCfaGfuGfuUfcUfuGfcUfcUfcUfaUfasAf | AS1315 | 1425 | uUfaUfaGfaGfcAfaGfaAfcAfcUfgUfusUfsu | 0.07 | 0.15 | 0.55 | |
| D1316 | S1316 | 334 | AfAcCfaGfuGfuUfcUfuGfcUfcUfcUfaUfauasAf | AS1316 | 1426 | uUfaUfAfUfaGfaGfcAfaGfaAfcAfcUfgUfususu | 0.07 | 0.16 | 0.53 | |
| D1317 | S1317 | 335 | AfacaGfuGfuUfcUfuGfcUfcUfcUfaUfasAf | AS1317 | 1427 | uUfaUfaGfaGfcAfaGfaAfcAfcUfgUfususu | 0.07 | 0.16 | 0.55 | |
| D1318 | S1318 | 336 | AfAcCfaGfuGfuUfcUfuGfcUfcUfcUfaUfasAf | AS1318 | 1428 | uUfaUfaGfaGfcAfaGfaAfcAfcUfgUfusUfsu | 0.10 | 0.32 | 0.61 | |
| D1319 | S1319 | 337 | AfAcCfaGfuGfuUfcUfuGfcUfcUfcUfaUfasAf | AS1319 | 1429 | uUfaUfaGfaGfcAfaGfaAfcAfcUfgUfususu | 0.08 | 0.16 | 0.53 | |
| D1320 | S1320 | 338 | AfAcCfaGfuGfuUfcUfuGfcUfcUfcUfaUfasAf | AS1320 | 1430 | uUfaUfaGfaGfcAfaGfaAfcAfcUfgUfususu | 0.08 | 0.16 | 0.61 | |
| D1321 | S1321 | 339 | AfAcCfaGfuGfuUfcUfuGfcUfcUfcUfaUfasAf | AS1321 | 1431 | uUfaUfagaGfcAfaGfaAfcAfcUfgUfusUfsu | 0.06 | 0.14 | 0.58 | |
| D1322 | S1322 | 340 | AfAcCfaGfuGfuUfcuuGfcUfcUfcUfaUfasAf | AS1322 | 1432 | uUfaUfaGfaGfcAfaGfaAfcAfcUfgUfusUfsu | 0.15 | 0.49 | 0.84 | |
| D1323 | S1323 | 341 | AfAcCfaGfuGfuUfcUfuGfcUfcUfcuaUfasAf | AS1323 | 1433 | uUfaUfAfGfaGfaGfcAfaGfaAfcAfcUfgUfusUfsu | 0.07 | 0.20 | 0.62 | |
| D1324 | S1324 | 342 | AfAcCfaGfuGfuUfcUfuGfcUfcUfcUfaUfasAf | AS1324 | 1434 | uUfaUfaGfaGfcAfaGfaAfcAfcUfgUfusUfsu | 0.08 | 0.25 | 0.78 | |
| D1325 | S1325 | 343 | AfAcCfaGfuGfuUfcUfuGfcUfcUfcUfaUfasAf | AS1325 | 1435 | uUfaUfaGfaGfcAfaGfaAfcAfcUfguusUfsu | 0.08 | 0.18 | 0.80 | |
| D1326 | S1326 | 344 | AfAcCfaGfuGfuUfcUfuGfcUfcUfcUfaUfAfasAf | AS1326 | 1436 | uUfauaGfaGfcAfaGfaAfcAfcUfgUfusUfsu | 0.07 | 0.21 | 0.66 | |
| D1327 | S1327 | 345 | AfAcCfaGfuGfuucGfcUfcUfcUfaUfasAf | AS1327 | 1437 | uUfaUfaGfaGfcAfaGfaAfcAfcUfgUfusUfsu | 0.10 | 0.31 | 0.70 | |
| D1328 | S1328 | 346 | AfAfCfaGfuGfuUfcUfuGfcUfcUfcUfauasAf | AS1328 | 1438 | uUfAfUfaGfaGfcAfaGfaAfcAfcUfguusUfsu | 0.07 | 0.15 | 0.55 | |
| D1329 | S1329 | 347 | AfAfCfaGfuGfuUfcUfuGfcUfcUfcUfaUfasAf | AS1329 | 1439 | uUfaUfaGfaGfcAfaGfaAfcAfcugUfgUfusUfsu | 0.08 | 0.19 | 0.71 | |
| D1330 | S1330 | 348 | AfAcCfaGfuGfuUfcUfuGfcUfcUfcUfaUfasAf | AS1330 | 1440 | uuaUfaGfcAfaGfcAfaGfaAfcAfcUfgUfusUfsu | 0.09 | 0.27 | 0.76 | |
| D1331 | S1331 | 349 | AfAcCfaGfuguvGfcUfuGfcUfcUfcUfaUfasAf | AS1331 | 1441 | uUfaUfaGfaGfcAfaGfaAfcAfcUfgUfusUfsu | 0.07 | 0.21 | 0.65 | |
| D1332 | S1332 | 350 | AfAcCfaGfuGfuUfcUfuGfcUfcuaUfaUfasAf | AS1332 | 1442 | uUfaUfaGfaGfcAfaGfaAfcAfcUfguusUfsu | 0.07 | 0.17 | 0.53 | |
| D1333 | S1333 | 351 | AfAcCfaGfuGfUfGfuUfcUfuGfcUfcUfaUfasAf | AS1333 | 1443 | uUfaUfaGfaGfcAfaGfaAfcAfcacUfgUfusUfsu | 0.08 | 0.25 | 0.73 | |
| D1334 | S1334 | 352 | AfAcCfaguGfuUfcUfuGfcUfcUfcUfaUfasAf | AS1334 | 1444 | uUfaUfaGfaGfcAfaGfaAfcAfcUfgUfusUfsu | 0.07 | 0.18 | 0.54 | |
| D1335 | S1335 | 353 | AfAcCfaGfuGfuUfcuuGfcUfcUfcUfaUfasAf | AS1335 | 1445 | uUfaUfaGfaGfcAfaGfaAfcAfcUfgUfususu | 0.14 | 0.38 | 0.57 | |
| D1336 | S1336 | 354 | AfAcCfaGfuGfuUfcUfuGfcUfcUfcUfaUfasAf | AS1336 | 1446 | uUfaUfaGfaGfcAfaGfaacAfcUfgUfusUfsu | 0.16 | 0.50 | 0.96 | |

TABLE 1-continued

RNAi Agents and Results of In Vitro Screening

| Duplex ID | s ID | SEQ ID NO: | Sense strand (S) | AS ID | SEQ ID NO: | Antisense strand (AS) | % of mRNA remained conc. of siRNA | | | IC50 (nM) |
|---|---|---|---|---|---|---|---|---|---|---|
| | | | | | | | 1 nM | 0.1 nM | 0.01 nM | |
| D1337 | S1337 | 355 | AfacCaGfuGfUfcUfuGfcUfcUfauasAf | AS1337 | 1447 | uUfaAfUfaUfaGfaGfcAfaGfaAfcAfcUfgUfusUfsu | 0.08 | 0.19 | 0.54 | |
| D1338 | S1338 | 356 | AfAfCfaGfuGfUfcUfugcUfcUfgCfUfasAf | AS1338 | 1448 | uUfaUfaUfaGfaGfcAfaGfcTfAfaGfaAfcAfcAfcUfgguusUfsu | 0.08 | 0.20 | 0.69 | |
| D1339 | S1339 | 357 | AfacCaGfuGfUfcUfuGfcUfcUfcUfaUfasAf | AS1339 | 1449 | uUfaUfaUfaGfaGfcAfagaAfcAfcAfcUfgUfusUfsu | 0.07 | 0.16 | 0.55 | |
| D1340 | S1340 | 358 | AfacCaGfuGfuUfcUfuGfcUfcUfcuaUfasAf | AS1340 | 1450 | uUfaUfaUfAfGfaGfcAfaGfcAfaGfaAfcAfcUfgUfusUfususu | 0.08 | 0.17 | 0.57 | |
| D1341 | S1341 | 359 | AfacCaGfuguUfcUfuGfcUfcUfaUfasAf | AS1341 | 1451 | uUfaUfaUfaGfaGfcAfaGfcAfaGfaAfcTfAfcUfgUfusususu | 0.21 | 0.22 | 0.63 | |
| D1342 | S1342 | 360 | AfAfCfaGfuGfUfcuuGfcuUfcUfcUfaUfasAf | AS1342 | 1452 | uUfaUfaUfaGfaGfcAfaGfcAfaGfaAfcAfcUfguusUfsu | 0.21 | 0.56 | 0.86 | |
| D1343 | S1343 | 361 | AfacCaGfUfUfcUfuGfcUfcUfaUfasAf | AS1343 | 1453 | uUfaUfaUfaGfaGfcAfaGfaacAfaAfcAfcUfgUfusUfsu | 0.14 | 0.37 | 0.73 | |
| D1344 | S1344 | 362 | AfacCaGfuGfuucUfuGfuUfuGfcUfcUfaUfasAf | AS1344 | 1454 | uUfaUfaUfaGfaGfcaaGfaAfcAfcAfcUfgUfusUfsu | 0.08 | 0.20 | 0.66 | |
| D1345 | S1345 | 363 | AfacCaGfuGfuUfGfuUfcuuGfcUfcUfcUfaUfasAf | AS1345 | 1455 | uUfaUfaUfaGfaGfcAfaGfaAfGfaAfcAfcugUfusUfsu | 0.12 | 0.34 | 0.73 | |
| D1346 | S1346 | 364 | AfacCaGfuGfUfUfcUfuGfcUfcUfcUfauasAf | AS1346 | 1456 | uUfaAfUfaUfaGfaGfcAfaGfaacAfcUfgUfusUfsu | 0.16 | 0.42 | 0.90 | |
| D1347 | S1347 | 365 | AfacCaGfuGfuGfUfUfcUfcuGfcUfcUfaUfasAf | AS1347 | 1457 | uUfaUfaUfaGfaGfcAfaGfcAfaGfaAfcAfcUfgUfusUfsUf | 0.17 | 0.43 | 0.85 | |
| D1348 | S1348 | 366 | AfacCaGfuGfUfUfGfUfcUfuGfcUfcUfaUfasAf | AS1348 | 1458 | uUfaUfaUfaGfaGfcAfaGfaAfcAfGfaAfcugUfusUfsu | 0.08 | 0.21 | 0.58 | |
| D1349 | S1349 | 367 | AfacCaGfuGfUfUfGfUfcUfuGfcUfuaUfasAf | AS1349 | 1459 | uUfaUfaUfAfGfaGfaGfcAfaGfcAfaGfaAfcAfcUfgUfusUfsu | 0.21 | 0.39 | 0.88 | |
| D1350 | S1350 | 368 | AfacCaguGfUfGfUfcUfuGfcUfcUfaUfasAf | AS1350 | 1460 | uUfaUfaUfaGfaGfcaaGfaAfcAfaGfaAfcAfcUfgUfusUfsu | 0.06 | 0.13 | 0.52 | |
| D1351 | S1351 | 369 | AfacCaAfgfuguUfcUfcUfuGfcUfcUfaUfasAf | AS1351 | 1461 | uUfaUfaUfaGfaGfcAfaGfcAfaGfaAfcAfcugUfusUfsu | 0.08 | 0.21 | 0.58 | |
| D1352 | S1352 | 370 | AfacCaAfgUfuGfUfUfcUfuGfcUfcUfaUfasAf | AS1352 | 1462 | uUfaUfaUfaGfaGfcAfaGfcAfaGfaAfcacUfgUfusUfsu | 0.18 | 0.49 | 0.84 | |
| D1353 | S1353 | 371 | AfacCaAfgUfGfUfUfcucUfuGfcUfcUfaUfasAf | AS1353 | 1463 | uUfaUfaUfaGfaGfcAfaGfcAfaGfaAfcAfcUfgUfusUfsu | 0.11 | 0.25 | 0.68 | |
| D1354 | S1354 | 372 | AfacaCaGfuGfUfUfcUfcaaGfcUfcUfaUfasAf | AS1354 | 1464 | uUfaUfaUfaGfaGfcAfcaaGfaAfcAfaGfaAfcAfcUfgUfusUfsu | 0.07 | 0.15 | 0.52 | |
| D1355 | S1355 | 373 | AfacCaGfUfUfGfuucUfuGfcUfcUfaUfasAf | AS1355 | 1465 | uUfaUfaUfaGfaGfcAfaGfcAfaGfaAfAfcacUfgUfusUfsu | 0.10 | 0.26 | 0.63 | |
| D1356 | S1356 | 374 | AfacCaGfUfUfGfuUfcUfugcUfcUfaUfasAf | AS1356 | 1466 | uUfaUfaUfaGfaGfcAfaGfcAfaGfaAfcAfaAfcacUfgUfusUfsu | 0.16 | 0.33 | 0.79 | |
| D1357 | S1357 | 375 | AfacCaAfGfuGfUfUfcUfuGfcUfcUfaUfasAf | AS1357 | 1467 | uUfaUfaUfaGfaGfcAfaGfcAfaGfaAfcAfcugUfusUfsUf | 0.09 | 0.19 | 0.51 | |
| D1358 | S1358 | 376 | AfacCaAfGfUfUfcuuGfcUfuGfcUfaUfasAf | AS1358 | 1468 | uUfaUfaUfaGfaGfcAfaGfcAfAfGfaacAfcUfgUfusUfsu | 0.22 | 0.48 | 0.71 | |

TABLE 1-continued

RNAi Agents and Results of In Vitro Screening

| Duplex ID | S ID | SEQ ID NO: | Sense strand (S) | AS ID | SEQ ID NO: | Antisense strand (AS) | % of mRNA remained conc. of siRNA | | | IC50 (nM) |
|---|---|---|---|---|---|---|---|---|---|---|
| | | | | | | | 1 nM | 0.1 nM | 0.01 nM | |
| D1359 | S1359 | 377 | AfacCfaGfuGfuUfcUfUfGfcUfcUfcUfaUfasAf | AS1359 | 1469 | uUfaUfaGfaGfcaaGfaAfcAfcUfgUfusUfsUf | 0.10 | 0.17 | 0.61 | |
| D1360 | S1360 | 378 | AfacCfaguGfuUfcUfUfGfcUfcUfcUfaUfasAf | AS1360 | 1470 | uUfaUfaGfaGfcAfaGfaacAfcUfgUfusUfsu | 0.14 | 0.40 | 0.87 | |
| D1361 | S1361 | 379 | AfacCfaGfuGfuUfcUfUfGfcUfcUfcuaUfasAf | AS1361 | 1471 | uUfaUfAfGfaGfcaaGfaAfcAfcUfgUfusUfsu | 0.07 | 0.14 | 0.52 | |
| D1362 | S1362 | 380 | aaCfaCfaGfuGfuUfcUfUfGfcUfcUfcUfaUfasAf | AS1362 | 1472 | uUfaUfaGfagcAfaGfaAfcAfcUfgUfusUfsu | 0.10 | 0.28 | 0.81 | |
| D1363 | S1363 | 381 | AfaCfaGfuGfuucUfUfGfcUfcUfcUfaUfAfUfasAf | AS1363 | 1473 | uUfauaGfaGfcAfaGfaAfcAfcUfgUfusUfsu | 0.06 | 0.16 | 0.68 | |
| D1364 | S1364 | 382 | AfacCfaGfuGfuUfcUfugcUfUfcUfcUfaUfAfsAf | AS1364 | 1474 | uuaUfaGfaGfCfaGfaAfcAfcUfgUfusUfsu | 0.09 | 0.26 | 0.67 | |
| D1365 | S1365 | 383 | aacaguguucugcucuauasa | AS1365 | 1475 | uUfaUfaGfaGfcAfaGfaAfcAfcUfgUfusUfsu | 0.20 | 0.59 | 0.95 | |
| D1366 | S1366 | 384 | AfacCfaGfuGfuUfcUfUfGfcUfcUfcUfauasAf | AS1366 | 1476 | uUfAfUfaUfaGfagcAfaGfaAfcAfcUfgUfusUfsu | 0.06 | 0.13 | 0.53 | |
| D1367 | S1367 | 385 | AfacCfaGfuGfuUfcUfUfGfcUfcUfcUfaUfAfsAf | AS1367 | 1477 | uUfaUfAfUfaGfagcAfaGfaAfcAfcUfgUfusUfsUf | 0.08 | 0.16 | 0.53 | |
| D1368 | S1368 | 386 | AfacCfaGfuguUfcUfUfGfcUfcUfcUfaUfAfsAf | AS1368 | 1478 | uUfauaGfaGfaGfcAfaGfaAfcAfcUfgUfusUfsu | 0.07 | 0.15 | 0.54 | |
| D1369 | S1369 | 387 | AfacCfaGfuGfuucUfUfGfcUfcUfcUfaUfAfsAf | AS1369 | 1479 | uuaUfaGfaGfaGfcAfaGfaAfcAfcUfgUfusUfsu | 0.23 | 0.56 | 0.89 | |
| D1370 | S1370 | 388 | AfacCfaGfuGfuUfcUfUfGfcUfugcUfaUfAfsAf | AS1370 | 1480 | uUfaUfAfGfagcAfaGfaAfcAfcUfgUfusUfsu | 0.06 | 0.12 | 0.55 | |
| D1371 | S1371 | 389 | AfacCfaGfuGfuUfcUfUfGfcUfcUfcuaUfasAf | AS1371 | 1481 | uUfaUfAfGfagcAfaGfaAfcAfcUfgUfusUfsu | 0.07 | 0.18 | 0.58 | |
| D1372 | S1372 | 390 | AfacCfaGfuGfuUfcUfUfGfcUfcUfcUfaUfasAf | AS1372 | 1482 | uUfauaGfaGfcAfaGfaAfcAfcUfgUfusUfsu | 0.06 | 0.15 | 0.56 | |
| D1373 | S1373 | 391 | AfacCfaGfuGfuucUfcUfUfGfcUfcUfcUfauasAf | AS1373 | 1483 | uuaUfaUfaGfaGfcAfaGfaAfcAfcUfgUfusUfsu | 0.21 | 0.51 | 0.89 | |
| D1374 | S1374 | 392 | AfacaGfuguUfcUfUfGfcUfcUfcUfaUfasAf | AS1374 | 1484 | uUfaUfaUfaGfagcAfaGfaAfcAfcUfgUfusUfsu | 0.08 | 0.21 | 0.64 | |
| D1375 | S1375 | 393 | AfacCfaGfuGfuUfcuuGfcUfcUfcUfaUfasAf | AS1375 | 1485 | uUfaUfaGfagcAfaGfaAfcAfcUfgUfusUfsu | 0.15 | 0.40 | 0.94 | |
| D1376 | S1376 | 394 | AfacCfaGfuGfuUfcuuGfcUfcUfcUfaUfAfsAf | AS1376 | 1486 | uUfaUfaGfagcAfaGfaAfcAfcUfgUfusUfsu | 0.13 | 0.40 | 0.96 | |
| D1377 | S1377 | 395 | AfacCfaGfuGfuUfcUfUfGfcUfcUfcUfauasAf | AS1377 | 1487 | uUfAfUfagaGfaGfcAfaGfaAfcAfcUfgUfusUfsu | 0.08 | 0.17 | 0.64 | |
| D1378 | S1378 | 396 | AfacCfaGfuGfuUfcUfUfGfcUfcUfcUfaUfAfsAf | AS1378 | 1488 | uuaUfaUfaGfaGfcAfaGfaAfcAfcUfgUfusUfsu | 0.18 | 0.50 | 0.97 | |
| D1379 | S1379 | 397 | AfacCfaGfuGfuucUfcUfUfGfcUfcUfcUfaUfasAf | AS1379 | 1489 | uUfaUfaUfaGfagcAfaGfaAfcAfcUfgUfusUfsu | 0.08 | 0.24 | 0.79 | |
| D1380 | S1380 | 398 | aaCfaGfuGfuucUfcUfUfGfcUfcUfcUfaUfAfsAf | AS1380 | 1490 | uUfauaGfaGfagcAfaGfaAfcAfcUfgUfusUfsu | 0.07 | 0.14 | 0.58 | |
| D1381 | S1381 | 399 | AfacCfaguGfuUfcUfcUfUfGfcUfcUfcUfaUfAfsAf | AS1381 | 1491 | uuaUfaGfaGfaGfcAfaGfaAfcAfcUfgUfusUfsu | 0.11 | 0.34 | 0.96 | |

TABLE 1-continued

RNAi Agents and Results of In Vitro Screening

| Duplex ID | S ID | SEQ ID NO: | Sense strand (S) | AS ID | SEQ ID NO: | Antisense strand (AS) | % of mRNA remained conc. of siRNA | | | IC50 (nM) |
|---|---|---|---|---|---|---|---|---|---|---|
| | | | | | | | 1 nM | 0.1 nM | 0.01 nM | |
| D1382 | S1382 | 400 | AfacCfaGfuguUfCfuGfCfUfcUfaUfasAf | AS1382 | 1492 | uUfaUfaGfagcAfaGfaAfCfAfcUfgUfusUfsu | 0.08 | 0.18 | 0.69 | |
| D1383 | S1383 | 401 | AfacCfaGfuGfuUfcuuGfcUfCfUfaUfasAf | AS1383 | 1493 | uUfaUfagaGfcAfAfGfaAfcAfcUfgUfusUfsu | 0.14 | 0.38 | 0.85 | |
| D1384 | S1384 | 402 | AfacCfaGfuGfuUfcUfuGfCfUfcUfAfUfasAf | AS1384 | 1494 | uUfauaGfaGfcAfagaAfcAfcUfgUfusUfsUf | 0.07 | 0.16 | 0.54 | |
| D1385 | S1385 | 403 | AfacaGfuGfuUfcUfuGfCfUfcUfaUfAfUfasAf | AS1385 | 1495 | uuaUfaGfaGfcAfagaAfcAfcUfgUfGfusUfsu | 0.08 | 0.20 | 0.75 | |
| D1386 | S1386 | 404 | aacaguucUfuGfcUfcUaudAsa | AS1386 | 1496 | uUfdAUdAGfaGfcAfagcAfaaCfadCfdGfdTsusu | 0.25 | 0.56 | 0.90 | |
| D1387 | S1387 | 405 | AfacCfagUfGfuUfCfUfuGfCfUfaUfasAf | AS1387 | 1497 | uUfaUfaGfagcAfaGfaAfcAfcUfgUfusUfsu | 0.08 | 0.19 | 0.70 | |
| D1388 | S1388 | 406 | AfacCfaGfuGfuuCfUfuGfcUfCfUfaUfasAf | AS1388 | 1498 | uUfaUfaGfaGfcAfaGfAfAfcUfgUfusUfsu | 0.08 | 0.14 | 0.60 | |
| D1389 | S1389 | 407 | AfacCfaGfuGfuUfCfcUfGfcUfcuaUfaUfAfsAf | AS1389 | 1499 | uuaUfAfAfGfaGfcAfaGfaAfcAfcUfgUfusUfsu | 0.08 | 0.19 | 0.62 | |
| D1390 | S1390 | 408 | aaCfaGfuGfuUfcUfcUfcUfcUfAfUfAfsAf | AS1390 | 1500 | uuaUfaGfaGfcAfaGfaaCfadCudGudTsusu | 0.08 | 0.27 | 0.76 | |
| D1391 | S1391 | 409 | aacaguucdTudGcdTcdTadTasa | AS1391 | 1501 | uUfdAUdAGfaGfcAfaadCadCudGudTasu | 0.18 | 0.36 | 0.81 | |
| D1392 | S1392 | 410 | AfacaGfuGfuUfCfuUfcUfUfaUfaUfasAf | AS1392 | 1502 | uUfaUfaGfagcAfaGfaAfcAfcUfgUfusUfsu | 0.07 | 0.17 | 0.55 | |
| D1393 | S1393 | 411 | AfacCfaGfuguUfCfuGfCfUfuUfaUfasAf | AS1393 | 1503 | uUfaUfagaGfcAfaGfaAfcAfcUfgUfusUfsu | 0.07 | 0.15 | 0.57 | |
| D1394 | S1394 | 412 | AfacCfaGfuGfuGfuUfcuuGfcUfCfUfAfUfasAf | AS1394 | 1504 | uUfauaGfaGfcAfAfGfAfAfcAfcUfgUfusUfsu | 0.26 | 0.68 | 1.06 | |
| D1395 | S1395 | 413 | AfacCfaGfuGfuUfcUfuGfcucUfaUfAfUfasAf | AS1395 | 1505 | uuaUfaGfaGfcAfaGfcAfaCfcUfaUfAfUfsu | 0.06 | 0.18 | 0.58 | |
| D1396 | S1396 | 414 | AfacCfaGfuGfuUfcUfuGfCfuCfUfaUfaUfasAf | AS1396 | 1506 | uuaUfaGfaGfcAfaGfcAfaGfcAfcUfgUfusUfsUf | 0.09 | 0.27 | 0.73 | |
| D1397 | S1397 | 415 | AfacCfaGfuGfuUfcUfuGfcAfdCdTdAfUfasaAf | AS1397 | 1507 | uUfadTdAdGdAfgGfAfcAfaGfaGfcAfcAfgUfusUfsu | 0.20 | 0.51 | 0.73 | |
| D1398 | S1398 | 416 | AfacaGfuGfuUfcuuGfcucUfasasaAf | AS1398 | 1508 | uUfAfAfUfaGfAfGfcAfAfGfAfAfcAfCfAfcUfGfUfusUfsu | 0.13 | 0.34 | 0.86 | |
| D1399 | S1399 | 417 | dAacadGugudTcuudGcucdTauasdA | AS1399 | 1509 | uUfdTdAdTadGdAdGcdAdAdGcdAdAdCacdTdGdTusdTsu | 0.24 | 0.42 | 0.82 | |
| D1400 | S1400 | 418 | AfacCfaAfuGfuUfcUfuGfdCdAdCdTaUfasAf | AS1400 | 1510 | uUfaUfadGdAdGdAdGcAfaGfaGfcAfcAfgUfusUfsu | 0.49 | 0.85 | 0.78 | |
| D1401 | S1401 | 419 | AfacAfaUfuUfcUfudGdCdAdCUfaUfasAf | AS1401 | 1511 | uUfaUfadGdAdGdAdGcAfaGfaGfcAfgUfusUfsu | 0.67 | 0.83 | 0.85 | |
| D1402 | S1402 | 420 | aaCfAfguUfgUfcUfUfgcUfcuaUfAfsa | AS1402 | 1512 | uUfaUfaUfagaGfcfaaGfaGfacAfcCfugUfUfusUfsu | 0.18 | 0.47 | 0.80 | |
| D1403 | S1403 | 421 | AfacAfaUfgUfuUfcUfuGfcdAdCUfadTdAsAf | AS1403 | 1513 | uGfdAUfadGdAdGcAfaGfaGfcAfcAfgUfusUfsu | 0.73 | 0.89 | 0.77 | |

TABLE 1-continued

RNAi Agents and Results of In Vitro Screening

| Duplex ID | S ID | SEQ ID NO: | Sense strand (S) | AS ID | SEQ ID NO: | Antisense strand (AS) | % of mRNA remained conc. of siRNA |  |  | IC50 (nM) |
|---|---|---|---|---|---|---|---|---|---|---|
| | | | | | | | 1 nM | 0.1 nM | 0.01 nM | |
| D1404 | S1404 | 422 | aacAgugUucuUgcuCuauAsa | AS1404 | 1514 | uUaUAgAGCaAGAaCACuGUUsusu | 0.12 | 0.39 | 0.79 | |
| D1405 | S1405 | 423 | AacaGuguUcuuGcucUauasA | AS1405 | 1515 | uUAUaGAGcAAGAaCAcUGUUsUsu | 0.12 | 0.37 | 0.77 | |
| D1406 | S1406 | 424 | AfacTaAfuGfuUfcUfuGdCAfcUfadTdAsAf | AS1406 | 1516 | udTdAUfaGfaGdCAfaGfaGfcAfcAfgUfusUfsu | 0.59 | 0.93 | 0.89 | |
| D1407 | S1407 | 425 | aACagUGuuCUugCUcuAUasa | AS1407 | 1517 | UUauAGagCAagAAcaCUguUsUsu | 0.09 | 0.16 | 0.55 | |
| D1408 | S1408 | 426 | AfacTaAfuGfuUfcUfuGfcAfcdTdAdTdAsAf | AS1408 | 1518 | udTdAdTdAGfcAfaGfcAfaGfaAfcAfcAfgUfusUfsu | 0.22 | 0.64 | 0.86 | |
| D1409 | S1409 | 427 | aaCAgUGUucUUgcUCuaUAsa | AS1409 | 1519 | uUaUAgaCaaGaacACugUUsusu | 0.13 | 0.31 | 0.76 | |
| D1410 | S1410 | 428 | AfacTaAfuGfuUfcUfuGfcAfdCdTdAdTdAsAf | AS1410 | 1520 | udTdAdTdAdGaGfcAfaGfaGfcAfcAfgUfusUfsu | 0.77 | 0.94 | 0.93 | |
| D1411 | S1411 | 429 | aacAfguGfucuUfgcuCfuauAfsa | AS1411 | 1521 | uUfaUfAfgAfGfCfaAfGfaAfcAfcAfCfuGfUfUfsusu | 0.23 | 0.53 | 1.04 | |
| D1412 | S1412 | 430 | aacdAgugdTucudTgcudCuaudAsa | AS1412 | 1522 | udTadTdAgdAgdAgdCadAdGdAadCadCadCudGdTdTsusu | 0.30 | 0.64 | 0.90 | |
| D1413 | S1413 | 431 | AfacTaGfuGfuUfcUfuGfcUfaUfaUfasa | AS1413 | 1523 | UfUfaUfaGfaGfcAfgAfaAfcAfcUfgUfusUfsu | 0.09 | 0.19 | 0.63 | |
| D1414 | S1414 | 432 | AfacTaGfuGfUfuUfcUfuGfcUfcUfaUfasa | AS1414 | 1524 | UfUfaUfaGfaGfcAfcAfaAfcAfcUfgUfusUfsu | 0.11 | 0.28 | 0.66 | |
| D1415 | S1415 | 433 | AfacTaGfuGfuUfcUfuGfcUfcUfaUfasa | AS1415 | 1525 | UfUfaUfaGfagcAfaGfaGfcAfcAfcUfgUfusUfsu | 0.06 | 0.13 | 0.53 | |
| D1416 | S1416 | 434 | aacaguguucuugcucuauasa | AS1416 | 1526 | UfUfaUfAfAfGfCfaAfGfAfcAfcAfcUfUfgUfUfsusu | 0.20 | 0.53 | 0.99 | |
| D1417 | S1417 | 435 | AfacTaGfuGfuUfcUfuGfcUfcUfAfUfasa | AS1417 | 1527 | UfUfauaGfaGfcCfuGfgagGfaGfaAfgUfcsCfsc | 0.07 | 0.17 | 0.53 | |
| D1418 | S1418 | 436 | aAfcTagUfGfuucCfUfugCfUfcuAfUfasa | AS1418 | 1528 | UfUfauaAfGfagCfAfagAfAfcaCfUfguUfsUfsu | 0.08 | 0.20 | 0.70 | |
| D1419 | S1419 | 437 | AfacTaAfGfuGfuUfcUfuGfcUfcUfaUfasAf | AS1419 | 1529 | uUfaUfaGfaGfcAfaGfaAfcAfcAfcugUfusUfsUf | 0.08 | 0.20 | 0.70 | |
| D1420 | S1420 | 438 | GfaCfuUfcUfcCfUfCfcAfguGfacTfcUfL96 | AS1420 | 1530 | aGfgUfcCfAfcCfugGfgagGfaGfaAfgUfcsCfsc | | | | |
| D1421 | S1421 | 439 | GfaCfuUfcUfcCfUfCfcAfcAfgUfGfacCfcUfL96 | AS1421 | 1531 | aGfgUfcCfccaCffuGfgagGfaGfaAfgUfcsCfsc | | | | |
| D1422 | S1422 | 440 | AfcUfcUfcUfcUfcCfaGfuggAfcCfuGfL96 | AS1422 | 1532 | cAfgGfucUfcCfAfcUfggaGfgAfgAfaGfcsCfsc | | | | |
| D1423 | S1423 | 441 | AfcUfcUfcUfcCfcUfcCfaGfuGfcGfaCfcUfgUfL96 | AS1423 | 1533 | cAfgGfuccAfcUfggaCfgUfgAfcCfuGfcsCfsc | | | | |
| D1424 | S1424 | 442 | CfuUfcUfcCfcCfuCfcAfgUfggacCfcUfgAfL96 | AS1424 | 1534 | uCfaGfguCfcCfcaCffuggaAfgGfaGfaAfgsUfsc | | | | |
| D1425 | S1425 | 443 | CfuUfcUfcUfccCfcCfaGfugGfuAfcCfcfgAfL96 | AS1425 | 1535 | uCfaGfgucCfaCffuggAfgGfaGfaAfgsUfsc | | | | |
| D1426 | S1426 | 444 | UfucUfcUfcCfcCfaGfuGfgaCfcUfgAfaFfL96 | AS1426 | 1536 | uUfcAfgGfUfcCfAfcugGfaGfgAfgAfasGfsu | | | | |

TABLE 1-continued

RNAi Agents and Results of In Vitro Screening

| Duplex ID | SEQ ID NO: s ID | Sense strand (S) | AS ID | SEQ ID NO: Antisense strand (AS) | % of mRNA remained conc. of siRNA 1 nM | 0.1 nM | 0.01 nM | IC50 (nM) |
|---|---|---|---|---|---|---|---|---|
| D1427 | S1427 445 | UfuCfuCfucfcCfAfgUfcCfAfgUfuGfgAfcCfcUfgGfaAfL96 | AS1427 | 1537 uUfcAfggucCfAfcugGfaGfgAfgAfasGfsu | | | | |
| D1428 | S1428 446 | UfcUfccCfuCfcAfgGfUfUfgGfaccUfgGfaGfAfaGfL96 | AS1428 | 1538 cUfuCfagGfGfUfcCfacuGfgAfgGfaGfasAfsg | | | | |
| D1429 | S1429 447 | UfcUfccCfuCfcAfgGfUfUfgGfaCfcUfUfgGfAfaGfL96 | AS1429 | 1539 cUfuCfaggUfcCfacuGfgAfgGfaGfasAfsg | | | | |
| D1430 | S1430 448 | CfuCfcUfcCfuCfcAfgUfUfgGfgAfcCfuUfgGfAfcGfL96 | AS1430 | 1540 cCfuUfcAfgGfGfuCfcacUfgGfaGfgAfgsAfsa | | | | |
| D1431 | S1431 449 | CfuuCfcUfcCfuCfcAfgGfUfUfgGfgAfcCfuUfgGfL96 | AS1431 | 1541 cCfuUfcagGfuCfcaCfUfgGfaGfgAfgsAfsa | | | | |
| D1432 | S1432 450 | UfcCfcUfcCfuCfcAfgUfGfUfgGfcAfcCfugAfaGfAfL96 | AS1432 | 1542 uCfcUfcUfucAfGfgUfccaCfuGfgAfggCfasGfsa | | | | |
| D1433 | S1433 451 | UfcUfccCfuCfcAfgUfGfUfgGfcAfcCfuUfgAfaGfL96 | AS1433 | 1543 ucUfcUfucaGfgUfcCfccaCfuGfgAfgsAfsa | | | | |
| D1434 | S1434 452 | CfcUfcCfagGfuGftuGfGfcAfcCfugaAfgGfaCfL96 | AS1434 | 1544 guCfcCftuUfcAfgGfuccAfgGfuccAfcUfgGfgsAfsg | | | | |
| D1435 | S1435 453 | CfcUfcCfagGfuGftuGfGfcAfcCfuUfgAfAfgGfaCfL96 | AS1435 | 1545 gUfcCfttucAfgGfuccAfgGfuccAfcUfgGfgsAfsg | | | | |
| D1436 | S1436 454 | CfuCfcAfgGfUfgGfAfcCfcUfgAfaGfgGfAfcGfL96 | AS1436 | 1546 cGfuCfcUfUfcAfgGfucCfaCfuGfgAfgsGfsa | | | | |
| D1437 | S1437 455 | CfuCfcAfgUfgGfGfcAfcCfcUfguGfAfAfgGfaAfgGfL96 | AS1437 | 1547 cGfuCfcuuCfaGfgucCfaCfuGfgAfgsGfsa | | | | |
| D1438 | S1438 456 | UfcCfaGfuGfgAfcCfcUfuGfAfaGfGfaAfL96 | AS1438 | 1548 uCfgUfcCfUfUfcAfggUfcCfAfcUfgGfgsGfsg | | | | |
| D1439 | S1439 457 | UfcCfaGfUfgGfgAfcCfcUfuGfaAfgAfaggAfcGfL96 | AS1439 | 1549 uCfgUfccuUfcAfggUfcCfAfcUfgGfasGfsg | | | | |
| D1440 | S1440 458 | CfcAfgUfgGfgAfcCfcUfgAfaggaAfcGfaGfL96 | AS1440 | 1550 cUfcGfucUfcCfUfUfcaggUfcCfaCfuGfgsAfsg | | | | |
| D1441 | S1441 459 | CfcAfgUfgGfgAfcCfcUfuGfaAfgGfaAfcGfaGfaGfL96 | AS1441 | 1551 cUfcGfuccCfUfcaggUfcCfaCfuGfgsAfsg | | | | |
| D1442 | S1442 460 | CfaGfuGfgGfaCfcCfUfgAfaGfgaAfcGfAfcGfaGfL96 | AS1442 | 1552 cCfuCfgUfcCfcUfUfcagGfucCfAfcUfgGfsAfsg | | | | |
| D1443 | S1443 461 | CfaGfuGfgGfaCfcfUfgAfaAfgGfaAfcGfAfcGfgGfL96 | AS1443 | 1553 cCfuCfgucCfuUfcagGfucCfAfcUfgGfsGfsa | | | | |
| D1444 | S1444 462 | AfgUfgGfaCfcUfgAfaAfgGfacAfgGfaCfGfL96 | AS1444 | 1554 cCfcUfcGfUfcCfUfucaGfgUfcCfaCfuugGfsg | | | | |
| D1445 | S1445 463 | AfgUfgGfaCfcUfgAfaAfgGfacGfgAfcGfL96 | AS1445 | 1555 cCfcUfcgucCfUfucaGfgUfcCfaCfuGfsg | | | | |
| D1446 | S1446 464 | GfuGfgAfcCfuGfaAfAfgGfacGfAfgGfaCfGfaAfL96 | AS1446 | 1556 uCfcCfucGfUfcCfuucAfgGfuCfcAfcUfsg | | | | |
| D1447 | S1447 465 | GfuGfgAfcCfuGfaAfgGfaAfcGfAfgGfaUfL96 | AS1447 | 1557 uCfcCfucgUfcCfuucAfgGfuCfcAfcsUfsg | | | | |
| D1448 | S1448 466 | UfgGfaCfcUfgAfAfgGfaCfgAfcgGfaUfL96 | AS1448 | 1558 aUfcCfcUfcGfucCfuucAfgGfuCfcCfasCfsu | | | | |

TABLE 1-continued

RNAi Agents and Results of In Vitro Screening

| Duplex ID | S ID | SEQ ID NO: | Sense strand (S) | AS ID | SEQ ID NO: | Antisense strand (AS) | % of mRNA remained conc. of siRNA | | | IC50 (nM) |
|---|---|---|---|---|---|---|---|---|---|---|
| | | | | | | | 1 nM | 0.1 nM | 0.01 nM | |
| D1449 | S1449 | 467 | UfgGfaCfcUfgAfAfGfgAfcGfAfGfgGfaUfL96 | AS1449 | 1559 | aUfcCfcfucGfuCfcuCfaGfuGfccfasCfsu | | | | |
| D1450 | S1450 | 468 | GfgAfccCfuGfaAfgGfAfcCfgagGfaGfiuGfL96 | AS1450 | 1560 | cAfuCfccfUfCfgUfccUfCfAfgGfuCfCfcsAfsc | | | | |
| D1451 | S1451 | 469 | GfgAfccCfuGfaAfgGfAfcGfgAfcGfgGfuCfcsAfsc | AS1451 | 1561 | cAfuCfccuCfgUfccUfCfAfgGfuCfcsAfsc | | | | |
| D1452 | S1452 | 470 | GfaCfcCfuGfaAfgGfAfcGfAfcfagGfaUfggGfL96 | AS1452 | 1562 | cCfaUfcCfCfUfCfgfuccUfuCfaGfgUfccCfsa | | | | |
| D1453 | S1453 | 471 | GfaCfcUfgAfAfgGfAfcGfAfcGfgAfuGfgGfL96 | AS1453 | 1563 | cCfaUfcccUfGfuccUfuCfaGfgUfcCfsa | | | | |
| D1454 | S1454 | 472 | AfcCfuGfaAfgGfAfcGfAfcGfgAfuGfgGfL96 | AS1454 | 1564 | cCfcAfuCfCfCfuCfguCfuUfcAfgGfusCfsc | | | | |
| D1455 | S1455 | 473 | AfcCfuGfaAfgGfAfcGfAfcGfgAfuGfggGfL96 | AS1455 | 1565 | cCfcAfuCfccCfuCfguCfcfuUfcAfgGfusCfsc | | | | |
| D1456 | S1456 | 474 | CfCfUfgAfaGfaAfgGfAfcCfgAfcGfaGfaGfsAfL96 | AS1456 | 1566 | uCfcCfaUfCfCfCfuCfcgfuCfcUfufCfaGfgsUfsc | | | | |
| D1457 | S1457 | 475 | CfCfUfgAfaGfaAfgGfAfcCfgAfgGfgAfuGfgGfsAfL96 | AS1457 | 1567 | uCfcCfaucCfCfufgfuCfcCfufuUfcCfaGfgsUfsc | | | | |
| D1458 | S1458 | 476 | CfuGfaAfgGfAfgGfaCfgAfuGfgAfuGfgGfAfL96 | AS1458 | 1568 | aUfcCfCfaUfCfCfafUfCfcfuUfCfAfgsGfsu | | | | |
| D1459 | S1459 | 477 | CfuGfaAfgGfAfcGfAfGfgGfaUfGfgGfaUfL96 | AS1459 | 1569 | aUfcCfCfcauCfCfufgUfcCfuUfcafgsGfsu | | | | |
| D1460 | S1460 | 478 | UfgAfaGfgAfcGfAfcGfAfaugGfaGfgGfaAfL96 | AS1460 | 1570 | aAfuCfcCfAfUfCfcucGfuCfCfuCfasGfsg | | | | |
| D1461 | S1461 | 479 | UfgAfaGfgAfcGfAfGfgGfgAfuGfGfaAfuUfL96 | AS1461 | 1571 | aAfuCfccaUfCfCfAfuCfccfuGfuCfcUfasGfsg | | | | |
| D1462 | S1462 | 480 | GfaaAfgGfaCfgAfcGfgGfAfAfuuGfGfuAfL96 | AS1462 | 1572 | aAfaUfcCfCfAfuCfccufGfuCfcCfuUfcsAfsg | | | | |
| D1463 | S1463 | 481 | GfaAfgGfaCfgAfcGfgGfGfaAfuUfgGfaUfL96 | AS1463 | 1573 | aAfaUfccccAfuCfccfcfgUfcCfuUfcsAfsg | | | | |
| D1464 | S1464 | 482 | AfaGfgAfcGfAfcGfgGfgAfuUfgGfgfaUfCfL96 | AS1464 | 1574 | gAfaAfucCfCfafUfcccUfCfgfuCfcfuUfusCfsa | | | | |
| D1465 | S1465 | 483 | AfaGfgAfcGfAfcGfgAfuUfgGfaUfuGfuCfAfL96 | AS1465 | 1575 | gAfAfuCfcaUfcCfccUfCfcUfcGfuCfcfUfsCfsa | | | | |
| D1466 | S1466 | 484 | AfcGfaCfgAfgGfGfaAfuGfgaUfgGfuUfcAfL96 | AS1466 | 1576 | uGfaAfaUfCfCfaAfuccCfcfgCfuCfcfus Ufsc | | | | |
| D1467 | S1467 | 485 | AfgGfaGfgAfgGfGfaAfuGfgAfuUfgGfaUfL96 | AS1467 | 1577 | uGfaAfaUfcCfAfuccCfgUfcCfusUfsc | | | | |
| D1468 | S1468 | 486 | GfgGfaAfgGfgAfuUfgGfgauUfcaUfcfuL96 | AS1468 | 1578 | aUfgAfAfaUfCfCfafuCfcfaUfcCfcfuCfcfUfsu | | | | |
| D1469 | S1469 | 487 | GfgAfcGfgAfgGfgAfuUfgGfuUfcaUfcfgL96 | AS1469 | 1579 | aUfgAfaauCfcfccAfuCfcAfaucCfgUfcCfcsUfsu | | | | |
| D1470 | S1470 | 488 | GfacCfgAfgGfgAfuUfgGfauUfcAfuUfgGfL96 | AS1470 | 1580 | cAfuGfaAfaUfCfcaucCfcfuCfgUfcCfsu | | | | |
| D1471 | S1471 | 489 | GfaCfgAfgGfgGfaUfUfgGfaUfUfUfcAfuGfL96 | AS1471 | 1581 | cAfuGfaauUfcCfcauCfcfuCfgUfcsCfsu | | | | |

TABLE 1-continued

RNAi Agents and Results of In Vitro Screening

| Duplex ID | SEQ ID NO: | S ID | Sense strand (S) | SEQ ID NO: | AS ID | Antisense strand (AS) | % of mRNA remained conc. of siRNA | | | IC50 (nM) |
|---|---|---|---|---|---|---|---|---|---|---|
| | | | | | | | 1 nM | 0.1 nM | 0.01 nM | |
| D1472 | 490 | S1472 | AfcGfaGfgGfaUfGfgAfuuuCfaUfgUfL96 | 1582 | AS1472 | aCfaUfgAfAfuCfccaUfcCfcUfcGfusCfsc | | | | |
| D1473 | 491 | S1473 | AfcGfaGfgGfaUfGfgGfgAfuUfUfCfaUfgUfL96 | 1583 | AS1473 | aCfaUfgaaAfuCfccaUfcCfcUfcGfusCfsc | | | | |
| D1474 | 492 | S1474 | CfgAfgGfgGfaUfuGfGfgGfaUfuuCfAfuGfuAfL96 | 1584 | AS1474 | uAfcAfugGfAfAfucccAfuCfcCfuCfgsUfsc | | | | |
| D1475 | 493 | S1475 | CfgAfgGfgGfaUfuGfGfgGfaUfuUfCfAfugUfuAfL96 | 1585 | AS1475 | uAfcAfugaAfaUfcccAfuCfcCfuCfgsUfsc | | | | |
| D1476 | 494 | S1476 | GfaGfgGfaUfGfgGfAfuUfucaUfgUfaAfL96 | 1586 | AS1476 | uUfaCfaUfgAfAfuccCfaUfcCfcUfcsGfsu | | | | |
| D1477 | 495 | S1477 | GfaGfgGfaUfGfgGfgGfAfuUfucCfAfUfUfgUfaAfL96 | 1587 | AS1477 | uUfaCfaUfgAfaAfucccUfaUfCfcUfcsGfsu | | | | |
| D1478 | 496 | S1478 | AfgGfgAfuGfgGfAfUfUfcaugCfAfUfgUfaCfL96 | 1588 | AS1478 | gUfaAfcAfUfgAfAfaucCfcAfuCfcCfusCfsg | | | | |
| D1479 | 497 | S1479 | AfgGfgAfuGfgGfgAfUfUfcAfUfUfgUfaCfL96 | 1589 | AS1479 | gUfaAfcauGfaAfauCfcAfuCfcCfusCfsg | | | | |
| D1480 | 498 | S1480 | GfgGfaUfgGfgGfaUfUfuCfaugUfaCfAfgUfuAfL96 | 1590 | AS1480 | gGfuaCfaUfgAfaauCfcCfaUfCfcCfusCfsc | | | | |
| D1481 | 499 | S1481 | GfgGfaUfgGfgGfaUfUfuCfaUfgUfaAfcCfL96 | 1591 | AS1481 | gGfuaCfaUfgAfaauCfcCfaUfCfcCfcsUfsc | | | | |
| D1482 | 500 | S1482 | GfgGfaUfgGfgGfAfUfuCfAfugaAfcAfcCfAfL96 | 1592 | AS1482 | uGfgUfuAfcCfcAfUgGfaaaUfcCfcAfuCfcsCfsu | | | | |
| D1483 | 501 | S1483 | GfgGfaUfgGfgGfaUfAfUfcAfugCfAfcCfAfL96 | 1593 | AS1483 | uGfgUfuacAfUfgGfaaaUfcCfaUfcCfcsCfsu | | | | |
| D1484 | 502 | S1484 | GfaUfgGfgGfAfUfuCfAfugUfaCfAfAfL96 | 1594 | AS1484 | uUfgGfuuaCfaUfgaaAfuCfCfaUfgCfcsCfsc | | | | |
| D1485 | 503 | S1485 | GfaUfgGfgGfaUfUfuCfAfUgGfuaaCfcCfAfL96 | 1595 | AS1485 | uUfgGfuuaCfUfgaaAfuCfCfaUfCfcsCfsc | | | | |
| D1486 | 504 | S1486 | AfuGfgGfgAfUfuCfAfUgGfuaaCfcCfAfAfgAfL96 | 1596 | AS1486 | cUfuGfuGfUfUfAfcCfAfugaAfuCfCfcAfUfcsCfsc | | | | |
| D1487 | 505 | S1487 | AfuGfgGfgAfUfuCfAfUgGfaAfcCfCfaAfgAfL96 | 1597 | AS1487 | cUfuGfuGfguuAfCfaUfgaAfuCfCfaUfcsCfsc | | | | |
| D1488 | 506 | S1488 | UfgGfgGfaUfuCfAfUfGfUfAfugAfcCfAfugAfgAfL96 | 1598 | AS1488 | uCfuUfgGfUfUfaCfAfugaAfaUfcCfcAfsUfsc | | | | |
| D1489 | 507 | S1489 | UfgGfgGfaUfUfuCfAfugGfuAfAfcCfcAfAfGfL96 | 1599 | AS1489 | uCfuUfgguUfaCfaugAfaAfUfcCfCfasUfsc | | | | |
| D1490 | 508 | S1490 | GfgGfgAfUfuCfAfUfgGfuAfaCfcAfaGfaGfL96 | 1600 | AS1490 | cUfcUfuGfGfUfUfAfcAfuGfaAfUfcCfcasUfsc | | | | |
| D1491 | 509 | S1491 | GfgGfaUfuCfAfUfgGfUfuAfaCfCfaAfgAfGfuL96 | 1601 | AS1491 | cUfcUfuggUfuAfcauGfUfaAfcauUfcCfcsAfsu | | | | |
| D1492 | 510 | S1492 | GfgAfuUfcCfaUfGfGfUfuAfaCfcAfaGfaGfuL96 | 1602 | AS1492 | aCfuCfuUfgGfUfuAfcaUfgAfaAfUfcCfcsCfsa | | | | |
| D1493 | 511 | S1493 | GfgAfuUfcCfaUfGfGfUfuAfaCfCfaAfgAfgUfL96 | 1603 | AS1493 | aCfuCfuugGfUfuAfcaGfuUfgAfaAfuCfcsCfsa | | | | |

TABLE 1-continued

RNAi Agents and Results of In Vitro Screening

| Duplex ID | S ID | SEQ ID NO: | Sense strand (S) | AS ID | SEQ ID NO: | Antisense strand (AS) | % of mRNA remained conc. of siRNA 1 nM | 0.1 nM | 0.01 nM | IC50 (nM) |
|---|---|---|---|---|---|---|---|---|---|---|
| D1494 | S1494 | 512 | GfaUfUfuCfAfuGfcAfaCfcaaGfaGfuAfL96 | AS1494 | 1604 | uAfcUfcUfUfgGfgUfuacAfuGfaAfAfaUfcsCfsc | | | | |
| D1495 | S1495 | 513 | GfaUfUfuCfAfugUfUfAfaCfcAfAfgGfaGfuAfL96 | AS1495 | 1605 | uAfcUfcuuGfgUfuacAfuGfaAfUfcsCfsc | | | | |
| D1496 | S1496 | 514 | AfuUfuCfaUfgUfAfAfcCfaaGfAfgUfAfgUfuAfL96 | AS1496 | 1606 | aUfaCfuCfUfUfgGfuuaCfaUfgAfaAfusCfsc | | | | |
| D1497 | S1497 | 515 | AfuUfUfcaUfgUfAfAfcCfaAfAfgGfuAfUfuUfL96 | AS1497 | 1607 | aUfaCfucuUfgGfuuaCfaUfgAfaAfusCfsc | | | | |
| D1498 | S1498 | 516 | UfuUfUfcAfugUfuAfAfcCfcAfagaGfaUfAfuUfL96 | AS1498 | 1608 | aAfaAfcUfCfUfuGfguuAfcAfuGfaAfasUfsc | | | | |
| D1499 | S1499 | 517 | UfuUfUfcAfugUfuAfAfcCfcAfaGfaGfuAfUfuUfL96 | AS1499 | 1609 | aAfaAfcuCfuUfgguuAfcAfuGfaAfasUfsc | | | | |
| D1500 | S1500 | 518 | UfuCfaUfgUfaAfCfcCfaAfgagUfaUfAfuUfcCfL96 | AS1500 | 1610 | gAfaAfUfaCfUfcUfuGfgguUfaCfaUfgAfasAfsu | | | | |
| D1501 | S1501 | 519 | UfuCfaUfgUfaAfcCfcAfaGfAfgUfAfuUfcCfL96 | AS1501 | 1611 | gAfaAfucuCfuUfgguUfaCfaUfgAfasAfsu | | | | |
| D1502 | S1502 | 520 | UfcAfuGfuAfaCfcCfAfaGfaguAfAfgUfAfuUfcCfL96 | AS1502 | 1612 | gGfaAfUfaCfUfUfuggUfuAfcAfuGfasAfsa | | | | |
| D1503 | S1503 | 521 | UfcAfuGfuAfaCfcCfAfaGfagUfAfUfuCfcAfL96 | AS1503 | 1613 | gGfaAfuacUfcfUfuggUfuAfcAfuGfasAfsa | | | | |
| D1504 | S1504 | 522 | CfaUfgUfaAfcCfCfAfaGfAfGfuAfUfuCfcAfL96 | AS1504 | 1614 | uGfgAfaUfAfUfcfuugGfuUfaCfaUfgsAfsa | | | | |
| D1505 | S1505 | 523 | CfaUfgUfaAfcCfcAfaGfAfGfuAfUfuCfcAfL96 | AS1505 | 1615 | uGfgAfauaCfuCfuugGfuUfaCfaUfgsAfsa | | | | |
| D1506 | S1506 | 524 | AfuGfuAfaCfcCfAfaFfGfaGfuauUfcCfaUfL96 | AS1506 | 1616 | aUfgGfaaUfAfUfcuuGfgUfuAfcAfusGfsa | | | | |
| D1507 | S1507 | 525 | AfuGfuAfaCfcCfaAfGfAfGfuAfUfuCfcAfUfL96 | AS1507 | 1617 | aUfgGfaauAfcUfcuuGfgUfuAfcAfusGfsa | | | | |
| D1508 | S1508 | 526 | UfgUfaAfcCfcAfaGfAfGfuAfUfuCfcAfUfuUfL96 | AS1508 | 1618 | aAfaUfggAfaAfUfcfuUfaCfuCfasUfsg | | | | |
| D1509 | S1509 | 527 | UfgUfaAfcCfaAfcCfaAfGfAfgUfAfuUfcCfAfuUfL96 | AS1509 | 1619 | aAfuGfgaaUfaCfucuUfgGfuUfacCfasUfsg | | | | |
| D1510 | S1510 | 528 | GfuAfaCfcCfaAfgAfGfAfGfuAfUfuCfaUfuUfL96 | AS1510 | 1620 | aAfaUfgGfAfAfuAfucucUfuGfgUfuAfcsAfsu | | | | |
| D1511 | S1511 | 529 | GfuAfaCfcCfaAfgAfGfuAfUfuCfcAfUfuUfL96 | AS1511 | 1621 | aAfaUfggaAfuAfcucUfuGfgUfuAfcsAfsu | | | | |
| D1512 | S1512 | 530 | UfaAfcCfcAfaGfAfgUfAfuUfccAfuUfuCfL96 | AS1512 | 1622 | aAfaAfuGfgAfAfuAfacuCfuUfgGfuUfasCfsa | | | | |
| D1513 | S1513 | 531 | UfaAfcCfcAfaGfaGfuUfAfuUfcCfAfuUfuCfL96 | AS1513 | 1623 | aAfaAfuggAfaUfacuCfuUfgGfuUfasCfsa | | | | |
| D1514 | S1514 | 532 | AfaCfcCfaAfgAfgUfuUfAfuUfcCfaUfuUfuUfL96 | AS1514 | 1624 | aAfaAfaUfGfGfaAfuacUfcUfuGfgUfusAfsc | | | | |
| D1515 | S1515 | 533 | AfaCfcCfaAfgAfGfuUfAfuUfcCfAfuUfuUfL96 | AS1515 | 1625 | aAfaAfaugGfaAfuUfcUfuGfgUfusAfsc | | | | |
| D1516 | S1516 | 534 | AfcCfaAfgAfgUfAfUfuCfcauUfuUfuAfL96 | AS1516 | 1626 | uAfaAfaUfGfgAfauaCfucUfuGfgUfusUfsa | | | | |

TABLE 1-continued

RNAi Agents and Results of In Vitro Screening

| Duplex ID | SEQ ID NO: | s ID | Sense strand (S) | SEQ ID NO: | AS ID | Antisense strand (AS) | % of mRNA remained conc. of siRNA | | | IC50 (nM) |
|---|---|---|---|---|---|---|---|---|---|---|
| | | | | | | | 1 nM | 0.1 nM | 0.01 nM | |
| D1517 | 535 | S1S17 | AfcCfaAfaAfgAfgUfaUfUfcCfcAfUfUfuUfuAfL96 | 1627 | AS1517 | uAfaAfaauGfgAfauaCfuCfuUfgGfusUfsa | | | | |
| D1518 | 536 | S1S18 | CfcAfaGfaGfuAfUfUfUfcCfaauUfuUfaCfL96 | 1628 | AS1518 | gUfaAfaAfaAfAfUfgGfaauAfcUfcUfuGfgsUfsu | | | | |
| D1519 | 537 | S1S19 | CfcAfaGfaGfuAfUfUfUfcCfaUfUfuUfuaCfL96 | 1629 | AS1519 | gUfaAfaaaUfgGfaaaUfcUfcUfuGfgsGfsu | | | | |
| D1520 | 538 | S1S20 | CfaAfgAfgUfaUfUfUfcCfcAfuuuUfuAfcUfL96 | 1630 | AS1520 | aGfuAfaaAfAfAfuGfgaaUfaCfuCfuUfgsGfsu | | | | |
| D1521 | 539 | S1S21 | CfaAfgAfgUfaUfUfUfCfcAfUfUfuUfuAfcUfL96 | 1631 | AS1521 | aGfuAfaaaAfuGfaaUfaCfuCfuUfgsGfsu | | | | |
| D1522 | 540 | S1S22 | AfaGfaGfuAfuUfCfcfaUfuuUfuaCfuAfL96 | 1632 | AS1522 | uAfgUfaAfAfAfaUfggaAfuAfcUfcUfusGfsg | | | | |
| D1523 | 541 | S1S23 | AfaGfaGfuAfuUfcCfcfaUfUfuUfuUfacUfaAfL96 | 1633 | AS1523 | uAfgUfaaAfaUfgGfaAfAfcUfcUfusGfsg | | | | |
| D1524 | 542 | S1S24 | AfgAfgUfaUfucCfcAfUfUfuUfuuuAfcUfaAfL96 | 1634 | AS1524 | uUfaGfuaaAfuAfAfAfuggAfaUfaCfuCfusUfsg | | | | |
| D1525 | 543 | S1S25 | AfgAfgUfaUfuCfcCfAfUfUfUfUfUfUfaCfuAfaAfL96 | 1635 | AS1525 | uUfaGfuaaAfuAfAfuGfaAfaUfaCfcUfusUfsg | | | | |
| D1526 | 544 | S1S26 | GfaGfuAfuUfcCfcAfUfUfuUfuacCfuAfaAfaAfL96 | 1636 | AS1526 | uUfuAfgufAfaAfaugGfaAfuAfcUfcsUfsu | | | | |
| D1527 | 545 | S1S27 | GfaGfuAfuUfcCfcAfUfUfuUfuUfuUfaCfuAfcCfuAfL96 | 1637 | AS1527 | uUfuAfguaAfuAfAfuCfuAfcUfusCfsu | | | | |
| D1528 | 546 | S1S28 | AfgUfaUfucCfcAfUfUfuUfuUfuacUfuaAfaGfL96 | 1638 | AS1528 | cUfuAfagCfUfAfAfaauGfgAfAfaCfusCfsu | | | | |
| D1529 | 547 | S1S29 | AfgUfaUfuCfcAfucCfaUfUfuUfuAfcUfaAfaGfL96 | 1639 | AS1529 | cUfuAfaguAfaAfaauGfgAfaUfgAfaUfcsCfsu | | | | |
| D1530 | 548 | S1S30 | GfuUfaUfCfcfaUfUfUfcAfuUfuUfAfcUfaAfgCfL96 | 1640 | AS1530 | gCfuUfuAfgUfAfAfaaaUfgGfaAfUfAfcsUfsc | | | | |
| D1531 | 549 | S1S31 | GfuAfuUfcCfcAfUfUfUfuUfaCfuAfaAfagCfL96 | 1641 | AS1531 | gCfuUfuAfgUfaAfaaUfgGfaAfUfAfcsUfsc | | | | |
| D1532 | 550 | S1S32 | UfaUfUfCfCfAfUfUfUfUfUfAfcUfaAfaGfcfL96 | 1642 | AS1532 | uGfcUfuUfAfgUfAfaaAfugGfaAfUfAfcCfsu | | | | |
| D1533 | 551 | S1S33 | UfaUfUfcCfcAfUfUfUfuUfaCfuaAfaAfgCfL96 | 1643 | AS1533 | uGfcUfuuaGfuAfaaAfuGfgAfAfUfaCfsu | | | | |
| D1534 | 552 | S1S34 | AfuUfccCfcfaUfUfUfuUfacuAfaAfgCfaGfL96 | 1644 | AS1534 | cUfgCfuUfAfgUfaaaAfuGfgGfaAfusAfsc | | | | |
| D1535 | 553 | S1S35 | AfuUfCfCfaUfUfUfuUfaCfuAfAfgCfagUfL96 | 1645 | AS1535 | cUfuGfCfuuuAfgUfaaAfAfuGfgAfAfusAfsc | | | | |
| D1536 | 554 | S1S36 | UfuCfcCfaUfuUfuUfuAfcUfaaaGfcAfgUfL96 | 1646 | AS1536 | aCfuGfcUfUfUfuAfgUfuaaAfAfuGfgAfusa | | | | |
| D1537 | 555 | S1S37 | UfcCfaUfuUfUfUfaCfuAfcUfaaAfgCfagUfL96 | 1647 | AS1537 | aCfuGfcuUfuAfgfuaaAfaAfuGfgAfasUfsa | | | | |
| D1538 | 556 | S1S38 | UfcCfaUfUfUfuUfaCfuAfaagCfagGfL96 | 1648 | AS1538 | cAfcUfgCfUfUfuUfaguaAfaAfuAfgGfasAfsu | | | | |

TABLE 1-continued

RNAi Agents and Results of In Vitro Screening

| Duplex ID | S ID | SEQ ID NO: | Sense strand (S) | AS ID | SEQ ID NO: | Antisense strand (AS) | % of mRNA remained conc. of siRNA 1 nM | 0.1 nM | 0.01 nM | IC50 (nM) |
|---|---|---|---|---|---|---|---|---|---|---|
| D1539 | S1539 | 557 | UfccfaUfuUfAfcfuAfaAfgCfcfaGfcfuGfL96 | AS1539 | 1649 | cAfcUfgcuUfuAfguaAfaAfaAfgGfaaAfsu | | | | |
| D1540 | S1540 | 558 | CfcAfuUfuAfcfUfuAfafCfuAfafagcAfgUfguUfL96 | AS1540 | 1650 | aCfaCfuGfcfUfuUfaguaAfaAfaAfaGfgsAfsa | | | | |
| D1541 | S1541 | 559 | CfcAfuUfuUfuAfCfuUfAfaAfgaCfgUfgUfgUfL96 | AS1541 | 1651 | aCfaCfugcUfuUfaguAfaAfaAfaAfuGfgsAfsa | | | | |
| D1542 | S1542 | 560 | CfaUfuUfuUfuAfaCfuUfAfaAfgcaCfgUfgiUfL96 | AS1542 | 1652 | aAfcAfcUfgCfcUfuagUfaAfaAfaAfUfgsGfsa | | | | |
| D1543 | S1543 | 561 | CfaUfuUfuUfuUfuaCfUfAfaAfgCfuAfGfuGfuUfL96 | AS1543 | 1653 | aAfcAfcugCfuUfuagUfaAfaAfaAfUfgsGfsa | | | | |
| D1544 | S1544 | 562 | AfUfuUfuUfacfUfAfaAfaGfcAfGfcUfgUfuUfL96 | AS1544 | 1654 | aAfaCfacfUfuGfcCfuUfuaGfuAfaAfaAfusGfsg | | | | |
| D1545 | S1545 | 563 | AfuUfuUfuUfacfUfAfaAfaAfgCfcAfgUfuUfL96 | AS1545 | 1655 | aAfaCfacuGfcCfuUfuaaGfuAfaAfaAfaGfsg | | | | |
| D1546 | S1546 | 564 | UfuUfuUfufacfUfaAfaAfAfgCfaAfgUfgiuUfL96 | AS1546 | 1656 | aAfaAfaCfaCfCfugCfuuuAfgUfaAfaAfaUfsg | | | | |
| D1547 | S1547 | 565 | UfuUfuUfuUfAfcfUfaAfaAfgfCfAfgGfuUfL96 | AS1547 | 1657 | aAfaAfcacUfgCfuuuAfgUfaAfaAfasUfsg | | | | |
| D1548 | S1548 | 566 | UfuUfuUfuUfaAfaAfgfCfAfgUfgugUfuUfuCfL96 | AS1548 | 1658 | gAfaAfcAfaCfCfuGfcuuUfaGfuAfaAfaAfsu | | | | |
| D1549 | S1549 | 567 | UfuUfuUfuUfAfaAfgfCfAfgUfgUfgUfuUfuCfL96 | AS1549 | 1659 | gAfaAfacaCfuGfcuuUfaGfuAfaAfaAfsu | | | | |
| D1550 | S1550 | 568 | UfuUfuacCfuAfaAfaGfcCfaGfugUfuUfuUfcAfL96 | AS1550 | 1660 | uGfaAfaAfaAfcAfcUfgcuUfuAfgUfaAfaAfsa | | | | |
| D1551 | S1551 | 569 | UfuUfaCfuAfaAfaGfcCfaGfuGfuUfuUfuCfaAfL96 | AS1551 | 1661 | uGfaAfaAfacAfcUfgcuUfuAfgUfaAfaAfsa | | | | |
| D1552 | S1552 | 570 | UfuUfufcUfaAfaAfgGfcCfAfgUfguuUfuCfaCfL96 | AS1552 | 1662 | gUfgAfaAfaAfcfaCfugcUfuAfgUfaAfaAfsa | | | | |
| D1553 | S1553 | 571 | UfuUfafcUfaAfaAfgGfcCfAfgUfgUfufuCfaCfL96 | AS1553 | 1663 | gUfgAfaaaCfaCfugcUfuAfgfuAfasAfsa | | | | |
| D1554 | S1554 | 572 | UfacCfuAfaAfgCfaGfcCfAfgfugUfuUfcAfcCfL96 | AS1554 | 1664 | gGfuGfaAfaAfcAfcugCfuuUfaGfuAfsAfsa | | | | |
| D1555 | S1555 | 573 | UfafCfuAfaAfgCfaGfcCfAfgfuGfuUfcAfcCfL96 | AS1555 | 1665 | gGfuGfaaaAfcAfcugCfuuUfaGfuAfgsAfsa | | | | |
| D1556 | S1556 | 574 | AfcfuAfaAfgCfcAfgfcCfaGfcUfgUfuUfcAfcCfL96 | AS1556 | 1666 | aGfugUfgAfaAfaCfacugCfuUfuAfgsAfsa | | | | |
| D1557 | S1557 | 575 | AfcUfaAfgCfaGfcCfaGfcUfgUfuUfcAfcCfuUfL96 | AS1557 | 1667 | aGfgUfgAfaAfcacAfacuGfcUfuUfaGfuAfsa | | | | |
| D1558 | S1558 | 576 | CfuAfagCfaGfcfaGfuUfgfuUfucAfcCfuCfuCfL96 | AS1558 | 1668 | gAfgGfuGfaAfAfcAfcacUfgCfuUfuAfgsUfsa | | | | |
| D1559 | S1559 | 577 | CfuAfaAfgCfaGfuUfgfuUfuUfcAfcCfuCfuCfL96 | AS1559 | 1669 | gAfgGfugaAfaAfcacUfgCfuUfuAfgsUfsa | | | | |
| D1560 | S1560 | 578 | UfaAfaGfcAfgUfgUfuUfucaCfcUfcUfcAfL96 | AS1560 | 1670 | uGfaGfgUfgAfAfacaCfugCfuUfuAfgsGfsu | | | | |
| D1561 | S1561 | 579 | UfaAfaAfgGfcAfgfgUfgUfuUfufuCfAfcCfuCfuCfAfL96 | AS1561 | 1671 | uGfaGfgugAfaAfacaCfuGfcUfuUfasGfsu | | | | |

TABLE 1-continued

RNAi Agents and Results of In Vitro Screening

| Duplex ID | SEQ ID NO: Sense strand (S) | | AS ID | SEQ ID NO: Antisense strand (AS) | | % of mRNA remained conc. of siRNA | | | IC50 (nM) |
|---|---|---|---|---|---|---|---|---|---|
| | s ID | | | | | 1 nM | 0.1 nM | 0.01 nM | |
| D1562 | S1562 | 580 AfaAfgCfaGfuGfUfUfUfcacCfuCfaUfaFL96 | AS1562 | 1672 aUfgAfgGfUfUfGfaAfaacAfcUfgCfuUfusAfsg | | | | | |
| D1563 | S1563 | 581 AfaAfgCfaGfuGfUfUfUfUfcAfCfCfucCfuCfaUfL96 | AS1563 | 1673 aUfgAfgguGfaAfaacAfcUfgCfuUfusAfsg | | | | | |
| D1564 | S1564 | 582 AfaGfcAfgUfgUfUfUfUfcaccUfcAfuAfiAfL96 | AS1564 | 1674 uAfuGfaGfGfUfgAfaaaCfcfuGfcUfusUfsa | | | | | |
| D1565 | S1565 | 583 AfaGfcAfgfuGfUfUfUfucCfaCfCfUfcAfuAfiAfL96 | AS1565 | 1675 uAfuGfaggUfgAfaaaCfaCfuGfCfUfusUfsa | | | | | |
| D1566 | S1566 | 584 AfgCfaGfuGfuUfUfUfcAfccuCfaUfaAfuL96 | AS1566 | 1676 aUfaUfaAfGfGfuGfaaaAfcAfcUfgCfusUfsu | | | | | |
| D1567 | S1567 | 585 AfgCfaGfuGfuUfUfUfcAfccCfaAfcAfuAfuL96 | AS1567 | 1677 aUfaUfgagGfuGfaaaAfcAfcUfgCfusUfsu | | | | | |
| D1568 | S1568 | 586 GfcAfgUfgUfuUfUfcCfaCfucAfuAfuGfL96 | AS1568 | 1678 cAfuAfugAfGfgUfgaaaAfCfaCfuGfcsUfsu | | | | | |
| D1569 | S1569 | 587 GfcAfgUfgUfuUfUfcAfCfcfuCfaCfaUfaAfugfL96 | AS1569 | 1679 cAfuAfugaGfgUfgaaaAfaCfaCfuGfcsUfsu | | | | | |
| D1570 | S1570 | 588 CfaGfuGfuUfuUfcAfcCfcAfcCfucaUfaUfgCfL96 | AS1570 | 1680 gCfaUfaUfGfAfGfGfugaAfaAfcUfgsCfsu | | | | | |
| D1571 | S1571 | 589 CfaGfuGfuUfuUfcAfCfcCfucCfaFAfUfaUfgCfL96 | AS1571 | 1681 gCfaUfaugAfgfugaAfaAfcAfcUfgsCfsu | | | | | |
| D1572 | S1572 | 590 AfgCfaGfuUfuCfAfcCfcAfcAfuAfugCfuL96 | AS1572 | 1682 aGfcAfuAfUfGfaGfugAfaAfaCfaCfusGfsu | | | | | |
| D1573 | S1573 | 591 AfgUfgUfuUfcAfcCfcAfcAfuAfugCfcUfL96 | AS1573 | 1683 aGfcAfuauGfaGfgugAfaAfaAfaCfaCfusGfsc | | | | | |
| D1574 | S1574 | 592 GfuGfuUfuUfcAfCfcCfcucCfauuGfcUfaFL96 | AS1574 | 1684 uAfgCfaUfAfUfgAfuAfggUfGfaAfaAfcAfcsUfsg | | | | | |
| D1575 | S1575 | 593 GfuGfuUfuUfcAfCfcCfuFcfauaUfGfcUfaAfL96 | AS1575 | 1685 uAfgCfauaUfAfggUfAfggUfGfaAfaAfcAffasCfsu | | | | | |
| D1576 | S1576 | 594 UfgUfuUfuUfcAfcCfcUfcAfauaUfgCfUfaUfL96 | AS1576 | 1686 aUfaGfcAfUfUfAfUfgaggUfgAfaAfaCfasCfsu | | | | | |
| D1577 | S1577 | 595 UfgUfuUfuUfcAfcCfcUfcAfuauAfugCfUfaFL96 | AS1577 | 1687 aUfaGfcauAfUfgaggUfgAfaAfaCfasCfsu | | | | | |
| D1578 | S1578 | 596 GfuUfuUfcAfcCfcUfcAfuAfuGfcUfaUfGfL96 | AS1578 | 1688 cAfuAfgCfAfUfgagGfuGfaAfaAfcsAfsc | | | | | |
| D1579 | S1579 | 597 GfuUfuUfcAfcCfcUfcAfuAfugCfuAfuGfL96 | AS1579 | 1689 cAfuAfgcaUfgagGfuGfaAfaAfasCfsc | | | | | |
| D1580 | S1580 | 598 UfuUfcAfcCfcUfcAfuAfugcUfaUfgUfL96 | AS1580 | 1690 aCfuAfgGfCfAfuAfugaGfgUfgAfaAfasCfsa | | | | | |
| D1581 | S1581 | 599 UfuUfcAfcCfcUfcAfuAfugCfcUfaUfgUfL96 | AS1581 | 1691 aCfaUfagcAfuAfugaGfgUfgAfaAfasCfsa | | | | | |
| D1582 | S1582 | 600 UfuUfcAfcCfcuCfaUfaUfgcuAfuGfUfL96 | AS1582 | 1692 aAfcAfuAfGfCfaUfaugAfgGfuGfaAfasAfsc | | | | | |
| D1583 | S1583 | 601 UfuUfcAfcCfcfuCfaFUfaUfaUfgCfUfaFfugUfL96 | AS1583 | 1693 aAfcAfuagCfaUfaugAfgGfuGfaAfasAfsc | | | | | |

TABLE 1-continued

RNAi Agents and Results of In Vitro Screening

| Duplex ID | SEQ ID NO: | Sense strand (S) | AS ID | SEQ ID NO: | Antisense strand (AS) | % of mRNA remained conc. of siRNA | | | IC50 (nM) |
|---|---|---|---|---|---|---|---|---|---|
| | | | | | | 1 nM | 0.1 nM | 0.01 nM | |
| D1584 | S1584 | 602 | UfucCaCfcUfcAfuGfcuaUfgUfuAfL96 | AS1584 | 1694 | uAfaCfaUfAfGfcAfuauGfaGfgAfaAfsa | | | | |
| D1585 | S1585 | 603 | UfuCfaCfcUfcAfUfaUfcUfAfGfUfuAfL96 | AS1585 | 1695 | uAfaCfauaGfcAfuauGfaGfgAfasAfsa | | | | |
| D1586 | S1586 | 604 | UfcAfcCfcUfcaUfaUfuUfgCfuauGfuUfaGfL96 | AS1586 | 1696 | cUfaAfcAfUfAfgCfauaUfgAfgGfuaAfsa | | | | |
| D1587 | S1587 | 605 | UfcAfccCfucUfaUfAfUfgCfuAfUfGfuUfaGfL96 | AS1587 | 1697 | cUfaAfcauAfgCfauaUfgAfgGfuGfasAfsa | | | | |
| D1588 | S1588 | 606 | CfaCfcUfcAfuAfUfGfcUfaugUfuAfgAfL96 | AS1588 | 1698 | uCfuAfaCfaUfaGfcauAfuGfaGfgUfgAfsa | | | | |
| D1589 | S1589 | 607 | CfaCfcUfcAfuAfUfGfcUfAfUfUfuAfgAfL96 | AS1589 | 1699 | uCfuAfacaUfgcauAfuGfaGfgUfgsAfsa | | | | |
| D1590 | S1590 | 608 | AfcCfuCfaUfaUfGfCfuaUfuGfUfUfaGfaAfL96 | AS1590 | 1700 | uUfcUfaAfCfAfuAfgcaUfaUfgAfgGfusGfsa | | | | |
| D1591 | S1591 | 609 | AfcCfuCfaUfaUfGfCfUfUfaUfuGfUfUfaGfaAfL96 | AS1591 | 1701 | uUfcUfaacAfuAfgcaUfaUfgAfgGfusGfsa | | | | |
| D1592 | S1592 | 610 | CfcUfcAfauGfCfUfUfaUfgUfuAfgAfGfL96 | AS1592 | 1702 | cUfuCfuAfaCfAfCfuaUfagcAfuAfuGfaGfgsUfsg | | | | |
| D1593 | S1593 | 611 | CfcUfcAfauGfcCfUfaUfgUfuAfagGfaAfgGfL96 | AS1593 | 1703 | cUfuCfuaaCfaUfagcAfuAfuGfaGfgsUfsg | | | | |
| D1594 | S1594 | 612 | CfuCfaUfgcCfUfUfaUfuGfuuaGfaAfgUfL96 | AS1594 | 1704 | aCfuUfcUfAfAfcAfuagCfaUfaUfgAfgsGfsu | | | | |
| D1595 | S1595 | 613 | CfuCfaUfgcCfuAfUfUfgUfUfaGfAfgUfL96 | AS1595 | 1705 | aCfuUfcuaAfcAfuagCfaUfaUfgAfgsGfsu | | | | |
| D1596 | S1596 | 614 | UfcAfaUfgfcUfAfUfgUfuagAfaAfuCfL96 | AS1596 | 1706 | gAfcUfucUfAfaCfauaGfcAfuAfuGfasGfsg | | | | |
| D1597 | S1597 | 615 | UfcAfaUfgfcUfAfUfgUfUfaGfaAfgUfcCfL96 | AS1597 | 1707 | gAfcUfucuAfaCfauaGfcAfuAfuGfasGfsg | | | | |
| D1598 | S1598 | 616 | CfaUfaUfgcCfuaUfgUfuAfagaAfgUfcCfL96 | AS1598 | 1708 | gGfaCfuUfCfUfaAfcauAfgCfaUfaUfgsAfsg | | | | |
| D1599 | S1599 | 617 | CfaUfaUfgCfUfaUfgUfuUfaAfgAfgUfcCfaGfL96 | AS1599 | 1709 | gGfaCfuucUfAfcauAfgCfaUfaUfgsAfsg | | | | |
| D1600 | S1600 | 618 | AfuAfuGfCfuAfUfGfUfuAfgaaGfucCfaGfL96 | AS1600 | 1710 | uGfgAfcUfUfCfuAfacaUfaGfcAfuAfusGfsa | | | | |
| D1601 | S1601 | 619 | AfuAfuGfcUfaUfGfUfuAfgaAfGfucCfaGfL96 | AS1601 | 1711 | uGfgAfcuuCfuAfacaUfaGfcAfuAfusGfsa | | | | |
| D1602 | S1602 | 620 | UfaUfgCfuAfUfuGfUfuAfgaGfucCfaGfL96 | AS1602 | 1712 | cUfgGfacUfUfcUfaacAfuAfgCfaUfasUfsg | | | | |
| D1603 | S1603 | 621 | UfaUfgCfUfaUfGfUfuAfgAfaGfaGfucCfaGfL96 | AS1603 | 1713 | cUfgGfacuUfcUfaaCfAfuAfgCfaUfasUfsg | | | | |
| D1604 | S1604 | 622 | AfuGfcUfaUfgfAfAfgAfucCfAfgGfL96 | AS1604 | 1714 | cCfuGfafcUfUfcUfuaaCfaUfaGfcAfusAfsu | | | | |
| D1605 | S1605 | 623 | AfuGfcUfaUfgUfuAfgAfAfgAfGfucCfAfgGfL96 | AS1605 | 1715 | cCfuGfgacUfuCfuaaCfaUfaGfcAfusAfsu | | | | |
| D1606 | S1606 | 624 | UfgCfuAfuGfuUfaFgAfaGfucCfaGfGfgCfL96 | AS1606 | 1716 | gCfcUfgfAfCfuUfcuaAfcAfuAfgCfasUfsa | | | | |

TABLE 1-continued

RNAi Agents and Results of In Vitro Screening

| Duplex ID | SEQ ID NO: | s ID | Sense strand (S) | SEQ ID NO: | AS ID | Antisense strand (AS) | % of mRNA remained conc. of siRNA | | | IC50 (nM) |
|---|---|---|---|---|---|---|---|---|---|---|
| | | | | | | | 1 nM | 0.1 nM | 0.01 nM | |
| D1607 | S1607 | 625 | UfgCfuAfgUfuUfAfgGfaAfgUfCfCfagGfgCfL96 | AS1607 | 1717 | gCfcUfggaCfuUfcuaAfcAfuAfgCfasUfsa | | | | |
| D1608 | S1608 | 626 | GfcUfaUfgUfuAfgGfAfaGfuccAfgGfcAfL96 | AS1608 | 1718 | uGfcCfuGfGfAfcUfucuAfaCfaUfaGfcsAfsu | | | | |
| D1609 | S1609 | 627 | GfcUfaUfgUfuAfgGfAfaGfuCfCfAfgGfcAfL96 | AS1609 | 1710 | uGfcCfuggaAfcUfucuAfaCfaGfcsAfsu | | | | |
| D1610 | S1610 | 628 | CfuAfuGfuUfaGfGfaAfAfgUfccaGfgCfaGfL96 | AS1610 | 1720 | cUfgCfcUfgGfGfaCfuucUfaAfcAfuAfgsCfsa | | | | |
| D1611 | S1611 | 629 | CfuAfuGfuUfaGfGfaAfAfgUfCfcAfgGfgCfaGfL96 | AS1611 | 1721 | cUfgCfcugGfaCfuuCfuuaAfaCfAfuAfgsCfsa | | | | |
| D1612 | S1612 | 630 | UfaUfgGfuUfaAfgGfAfAfGfuCfcagGfcAfgAfL96 | AS1612 | 1722 | uCfuGfcCfuGfGfAfcuuCfuAfaCfaUfasGfsc | | | | |
| D1613 | S1613 | 631 | UfaUfgGfuUfaAfgaAfAfGfucCfcAfGfgCfAfL96 | AS1613 | 1723 | uCfuGfccuGfAfcuuCfuAfaCfaUfasGfsc | | | | |
| D1614 | S1614 | 632 | AfuGfuUfaGfaAfGfuUfccCfaggCfaGfaGfL96 | AS1614 | 1724 | cUfcUfgCfcUfGfgacUfcUfaAfcAfusAfsg | | | | |
| D1615 | S1615 | 633 | AfuGfuUfaGfaAfGfuUfCfCfAfgGfaGfaGfL96 | AS1615 | 1725 | cUfcUfgccUfgGfacuUfcUfaAfcAfusAfsg | | | | |
| D1616 | S1616 | 634 | UfgUfuAfaGfaAfgUfCfCfaAfgGfaGfaGfL96 | AS1616 | 1726 | uCfcUfcUfgCfCfCfuGfgaCfuUfcUfaAfcAfasUfsa | | | | |
| D1617 | S1617 | 635 | UfgUfuAfaGfAfaGfuCfCfAfaGfGfaGfAfL96 | AS1617 | 1727 | uCfcUfcUfugcCfuGfgacUfucUfuAfaCfasUfsa | | | | |
| D1618 | S1618 | 636 | GfuUfaGfaAfgUfCfCfaGfaGfaCfaCfL96 | AS1618 | 1728 | gUfcUfcUfGfcCfUfggaCfuUfcUfaAfcAfsu | | | | |
| D1619 | S1619 | 637 | GfuUfaGfaAfgAfuCfCfAfgGfCfAfgAfgAfcAfL96 | AS1619 | 1729 | gUfcUfcugCfcUfgGfAfcUfuCfuUfaAfcCfsa | | | | |
| D1620 | S1620 | 638 | UfuAfgAfaGfuCfCfAfgGfCfaAfgGfAfcAfL96 | AS1620 | 1730 | uGfuCfuCfUfGfCfCfuggAfcUfuCfuAfasCfsa | | | | |
| D1621 | S1621 | 639 | UfuAfgAfaGfuCfCfAfgGfCfAfgGfCfAfgGfAfcAfL96 | AS1621 | 1731 | uGfuCfuCfugUfgCfCfuggAfcUfUfCfuAfasCfsa | | | | |
| D1622 | S1622 | 640 | UfaGfaAfgUfCfCfAfgGfCfagaCfaAfL96 | AS1622 | 1732 | uUfgUfcUfCfUfgCfcuGfaCfuUfcUfasAfsc | | | | |
| D1623 | S1623 | 641 | UfaGfaAfgUfcCfAfgGfCfagCfaaAfL96 | AS1623 | 1733 | uUfgUfcucUfgCfcuGfaCfuUfcUfusAfsa | | | | |
| D1624 | S1624 | 642 | AfgAfaGfuCfcAfgGfcAfgagaAfcAfAfuUfL96 | AS1624 | 1734 | aUfuGfuCfUfCfuGfccuGfAfcUfuCfusAfsa | | | | |
| D1625 | S1625 | 643 | AfgAfaGfucCfaGfGfcAfgGfcAfaCfaAfL96 | AS1625 | 1735 | aUfuGfuCfucUfuGfccuGfAfcUfuCfusAfsa | | | | |
| D1626 | S1626 | 644 | GfaAfgUfcCfaGfGfcAfgaAfuAfL96 | AS1626 | 1736 | aUfuGfuCfUfcUfGfcCfuGfgaCfuUfcsUfsa | | | | |
| D1627 | S1627 | 645 | GfaAfgUfCfCfaGfGfcAfgAfCfaAfL96 | AS1627 | 1737 | uAfuUfgucUfcUfgCfcUfggCfaCfuUfcsUfsa | | | | |
| D1628 | S1628 | 646 | AfaGfuCfCfaGfGfCfAfgGfacAfuAfaFfL96 | AS1628 | 1738 | uUfaUfuGfUfCfcUfugcCfuGfgAfcUfusCfsu | | | | |

TABLE 1-continued

RNAi Agents and Results of In Vitro Screening

| Duplex ID | S ID | SEQ ID NO: | Sense strand (S) | AS ID | SEQ ID NO: | Antisense strand (AS) | % of mRNA remained conc. of siRNA 1 nM | 0.1 nM | 0.01 nM | IC50 (nM) |
|---|---|---|---|---|---|---|---|---|---|---|
| D1629 | S1629 | 647 | AfaGfuCfcAfggGfcAfgGfcAfgAfcAfCfAfaAfaAfL96 | AS1629 | 1739 | uUfaAfuguCfuCfugcCfuGfgAfcUfusCfsu | | | | |
| D1630 | S1630 | 648 | AfgUfccCfagGfcAfgGfaGfacaAfuAfaAfaAfL96 | AS1630 | 1740 | uUfaAfuAfgUfGfuCfuCfugCfcUfgGfaCfusUfsc | | | | |
| D1631 | S1631 | 649 | AfguCfccCfagGfcAfgGfaGfaGfcAfcaUfaAfaaAfL96 | AS1631 | 1741 | uUfuAfuugUfuCfugCfcUfcUfugGfaCfusUfsc | | | | |
| D1632 | S1632 | 650 | GfuCfcCfagGfcAfgGfcAfgAfgCfaCfaaUfaAfaAfL96 | AS1632 | 1742 | uUfuAfuUfGfGfuCfucuGfcCfuGfgAfcsUfsu | | | | |
| D1633 | S1633 | 651 | GfuCfcCfagGfcAfgGfcAfgAfgCfaCfaAfUfaAfaaAfL96 | AS1633 | 1743 | uUfuAfuauuGfuCfucuGfcCfuGfgAfcsUfsu | | | | |
| D1634 | S1634 | 652 | UfccCfaGfgCfagGfcAfgCfaCfaauAfaAfaCfL96 | AS1634 | 1744 | gUfuUfuAfuUfGfucuCfgCfuGfgCfasCfsu | | | | |
| D1635 | S1635 | 653 | UfccCfagGfcCfagGfcAfgCfaCfaaUfaAfaAfaCfAfL96 | AS1635 | 1745 | gUfuaUfuauUfgUfcucCfgCfcUfggCfasCfsu | | | | |
| D1636 | S1636 | 654 | CfcAfggGfcAfgGfcAfgCfaCfaAfuAfauaAfaCfAfL96 | AS1636 | 1746 | uGfuUfUfaAfUfuGfucucCfuGfcCfuGfgAfsc | | | | |
| D1637 | S1637 | 655 | CfcAfgGfcAfgGfaCfaAfCfaAfuAfaAfaAfcAfL96 | AS1637 | 1747 | uGfuUfuaaUfuGfucCfuGfcCfuGfgsAfsc | | | | |
| D1638 | S1638 | 656 | CfagGfcCfagGfcAfgCfaAfuaaAfaCfAfCfaUfL96 | AS1638 | 1748 | aUfgUfuUfUfAfaUfGfucUfcCfuGfgsGfsa | | | | |
| D1639 | S1639 | 657 | CfgaGfgcCfagGfcAfgCfAfaAfCfAfAfuUfCfaUfL96 | AS1639 | 1749 | aUfgUfuuuAfuUfgucUfcUfGfgsGfsa | | | | |
| D1640 | S1640 | 658 | AfgGfcAfggGfaCfAfgCfAfAfaAfcAfuUfL96 | AS1640 | 1750 | aAfuGfuUfUfaUfuguCfuCfuGfcCfusGfsg | | | | |
| D1641 | S1641 | 659 | AfgGfcAfgGfaGfcAfcAfAfuAfAfaAfcAfuUfL96 | AS1641 | 1751 | aAfuGfuuuUfaUfuguCfuCfuGfcCfusGfsg | | | | |
| D1642 | S1642 | 660 | AfgGfcAfgGfaCfaCfAfAfuAfaAfaCfAfuCfL96 | AS1642 | 1752 | gAfaUfgUfUfuAfuugUfcUfcUfgCfcsUfsg | | | | |
| D1643 | S1643 | 661 | GfgCfaGfaGfcAfCfaAfuAfaAfaCfAfuCfL96 | AS1643 | 1753 | gAfaUfguuUfuAfuugUfcUfcUfgCfcsUfsg | | | | |
| D1644 | S1644 | 662 | GfcCfaGfgAfgCfaCfaAfuAfaAfaCfAfuUfcCfL96 | AS1644 | 1754 | gGfaaAfuGfuUfuauuGfuCfuCfuGfcsCfsu | | | | |
| D1645 | S1645 | 663 | GfcCfaGfgAfgCfaAfuAfaAfaAfcAfuUfcCfL96 | AS1645 | 1755 | gGfaAfuGfuUfuAfauuGfuCfuCfuGfcsCfsu | | | | |
| D1646 | S1646 | 664 | CfcAfgGfaGfcAfcAfAfuAfacaUfcAfuUfcUfL96 | AS1646 | 1756 | aGfgAfaUfGfuUfuauUfgUfcUfcUfgsCfsc | | | | |
| D1647 | S1647 | 665 | CfaGfgAfgCfaCfaAfuAfaAfaAfcAfuUfcCfL96 | AS1647 | 1757 | aGfgAfaugUfuUfuauUfgUfcUfcUfgsCfsc | | | | |
| D1648 | S1648 | 666 | AfgGfaGfcAfcAfAfuAfaAfacAfuUfcCfuUfL96 | AS1648 | 1758 | cAfgGfaaUfGfuUfuaaUfgUfcUfcsUfsc | | | | |
| D1649 | S1649 | 667 | AfgGfaGfcAfcAfAfuAfaAfAfcAfuUfcCfuGfL96 | AS1649 | 1759 | cAfgGfaauGfuUfuuaUfgUfcUfcsUfsc | | | | |
| D1650 | S1650 | 668 | GfaGfaCfaAfuAfaFfaAfcAfuUfcCfuUfgUfL96 | AS1650 | 1760 | aCfaGfAfAfuGfuuuAfuUfgUfcUfcsUfsg | | | | |
| D1651 | S1651 | 669 | GfaGfaCfaAfuAfAfaFfaCfaUfuCfcUfgUfL96 | AS1651 | 1761 | aCfaGfgaaUfgUfuuuAfuUfgUfcUfcsUfsg | | | | |

TABLE 1-continued

RNAi Agents and Results of In Vitro Screening

| Duplex ID | s ID | SEQ ID NO: | Sense strand (S) | AS ID | SEQ ID NO: | Antisense strand (AS) | % of mRNA remained conc. of siRNA 1 nM | 0.1 nM | 0.01 nM | IC50 (nM) |
|---|---|---|---|---|---|---|---|---|---|---|
| D1652 | S1652 | 670 | AfgAfcAfaUfaAfaAfAfcAfuccCfuGfuGfL96 | AS1652 | 1762 | cAfcAfcAfgGfAfAfuGfuuuUfaUfuGfcCfusCfsu | | | | |
| D1653 | S1653 | 671 | AfgAfcAfaUfaAfaAfAfcAfuCfCfuGfuGfL96 | AS1653 | 1763 | cAfcAfggaAfuGfuuuUfaUfuGfcCfusCfsu | | | | |
| D1654 | S1654 | 672 | GfaCfaAfuAfaAfAfcCfaUfuccUfgUfgAfL96 | AS1654 | 1764 | uCfaCfaGfGfAfAfUfguuUfuAfuUfgUfcsUfsc | | | | |
| D1655 | S1655 | 673 | GfaCfaAfuAfaAfAfcCfaUfuCfCfuUfgAfgAfL96 | AS1655 | 1765 | uCfaCfaggAfaUfguuUfuAfuUfgUfcsUfsc | | | | |
| D1656 | S1656 | 674 | AfcCfaAfuAfaAfAfcCfaUfcccUfgCfuAfAfL96 | AS1656 | 1766 | uUfcAfcAfCfAfgGfaAfuguUfuaUfuGfusCfsu | | | | |
| D1657 | S1657 | 675 | AfcCfaAfuAfaAfAfcCfaUfuCfCfuGfuGfaAfL96 | AS1657 | 1767 | uUfcAfcagGfaAfuguUfuaUfuGfusCfsu | | | | |
| D1658 | S1658 | 676 | CfaAfuAfaAfaCfaUfucCfcugUfgAfaAfL96 | AS1658 | 1768 | uUfuCfcAfCfAfgGfAfgAfaugUfuAfuUfgsUfsc | | | | |
| D1659 | S1659 | 677 | CfaAfuAfaAfaCfaUfuCfCfuGfuGfaAfL96 | AS1659 | 1769 | uUfuCfacaGfgAfaugUfuAfuUfgsUfsc | | | | |
| D1660 | S1660 | 678 | AfaUfaAfaAfcaUfuCfCfugUfgAfaAfgAfL96 | AS1660 | 1770 | cUfuUfcAfCfAfgGfaauGfuUfuUfaUfusGfsu | | | | |
| D1661 | S1661 | 679 | AfaUfaAfaAfcaUfuCfCfuGfuGfaAfgAfL96 | AS1661 | 1771 | cUfuUfcacAfgGfaauGfuUfuUfaUfusGfsu | | | | |
| D1662 | S1662 | 680 | AfuUfaAfaAfcfaUfcCfuGfugAfaAfgGfL96 | AS1662 | 1772 | cCfuUfcAfcCfaGfaGfgaaUfgUfuUfAfusUfsg | | | | |
| D1663 | S1663 | 681 | AfuAfaAfacCfaUfuCfcUfgUfgAfAfgGfL96 | AS1663 | 1773 | cCfuUfcacAfgGfgaaUfgUfuUfAfusUfsg | | | | |
| D1664 | S1664 | 682 | UfaAfaAfaCfaUfuCfCfuGfugAfaAfaGfCfL96 | AS1664 | 1774 | gCfcUfuUfcAfcAfggaAfuGfuUfuUfasUfsu | | | | |
| D1665 | S1665 | 683 | UfaAfaAfcAfuUfcCfuGfugAfaAfgGfCfL96 | AS1665 | 1775 | gCfcUfuucAfcAfggaAfuGfuUfuUfasUfsu | | | | |
| D1666 | S1666 | 684 | AfaAfaAfcAfuUfcCfuGfugAfaaGfGfcAfL96 | AS1666 | 1776 | uGfcCfuUfuCfcAfCfaggAfaUfgUfuUfasAfsu | | | | |
| D1667 | S1667 | 685 | AfaAfaCfaUfuCfCfuGfugAfaaGfGfcAfL96 | AS1667 | 1777 | uGfcCfuuuCfaCfaggAfaUfgUfuUfasAfsu | | | | |
| D1668 | S1668 | 686 | AfaAfcAfuUfcCfuGfugAfaAfgGfcAfCfL96 | AS1668 | 1778 | gUfgCfCfuuUfCfAfcAfggGfaAfuGfuUfusUfsa | | | | |
| D1669 | S1669 | 687 | AfaAfcAfuUfcCfuGfuGfaAfaGfGfcAfCfL96 | AS1669 | 1779 | gUfgCfcuuUfcAfcAfgGfaAfuGfuUfusUfsa | | | | |
| D1670 | S1670 | 688 | AfaCfaUfuCfcUfgUfgAfaagGfcAfCfuFL96 | AS1670 | 1780 | aGfuGfcCfuUfuCfaCfaGfaAfuGfuUfsUfsu | | | | |
| D1671 | S1671 | 689 | AfaCfaUfuCfcUfgUfgAfaAfgGfcAfcUfL96 | AS1671 | 1781 | aGfuGfccuUfcAfcaGfaAfuGfuUfsUfsu | | | | |
| D1672 | S1672 | 690 | AfcAfuUfcCfuGfuGfaAfaGfGfcAfcCfuUfL96 | AS1672 | 1782 | aAfgUfgCfCfuUfuCfacaCfgAfaAfGfaAfusUfsu | | | | |
| D1673 | S1673 | 691 | AfcAfuUfcCfuGfuGfaAfaGfGfcCfuCfuUfL96 | AS1673 | 1783 | aAfgUfgccUffcUfuCfcacAfgGfaAfuGfusUfsu | | | | |

TABLE 1-continued

RNAi Agents and Results of In Vitro Screening

| Duplex ID | SEQ ID NO: | S ID | Sense strand (S) | SEQ ID NO: | AS ID | Antisense strand (AS) | % of mRNA remained conc. of siRNA 1 nM | 0.1 nM | 0.01 nM | IC50 (nM) |
|---|---|---|---|---|---|---|---|---|---|---|
| D1674 | 692 | S1674 | CfaUfuCfcUfgUfgAfaAfggcAfcUfuUfL96 | 1784 | AS1674 | aAfaGfuGfcCfufucaCfaGfgAfaUfgsUfsu | | | | |
| D1675 | 693 | S1675 | CfaUfuCfcUfgUfgAfaAfgGfcCfAfcUfuUfL96 | 1785 | AS1675 | aAfaGfugcCfufucaCfaGfgAfaUfgsUfsu | | | | |
| D1676 | 694 | S1676 | AfuUfcCfcUfgUfgAfaAfaGfgcaCfuUfuUfL96 | 1786 | AS1676 | aAfaAfgUfGfcCfuucAfcAfgGfaAfusGfsu | | | | |
| D1677 | 695 | S1677 | AfuUfcCfcUfgUfgAfaAfaGfgCfAfcUfuUfL96 | 1787 | AS1677 | aAfaAfgugCfcCfuucAfcAfgGfaAfusGfsu | | | | |
| D1678 | 696 | S1678 | UfuUfcCfcUfgUfgAfaAfaGfgCfcacUfuUfCfL96 | 1788 | AS1678 | gAfaAfaGfaGfuUfgCfcCfuuuCfaCfaGfgAfasUfsg | | | | |
| D1679 | 697 | S1679 | UfuUfcCfcUfgUfgAfaAfaGfgCfcAfCfUfuUfuCfL96 | 1789 | AS1679 | gAfaAfaguGfcCfuuucCfaCfaGfgAfasUfsg | | | | |
| D1680 | 698 | S1680 | UfcCfcUfgUfgAfaAfaGfgCfcAfcUfuUfUfcAfL96 | 1790 | AS1680 | uGfaAfaAfaGfGfUfgCfcuuUfcAfcAfgGfasAfsu | | | | |
| D1681 | 699 | S1681 | UfcCfcUfgUfgAfaAfaGfgCfaCfuUfUfUfcAfL96 | 1791 | AS1681 | uGfaAfaagUfgCfcuuUfcAfcAfgGfasAfsu | | | | |
| D1682 | 700 | S1682 | CfcUfgUfgAfaAfaGfgCfcAfcUfuUfuCfaUfL96 | 1792 | AS1682 | aUfgAfaAfaAfGfuGfcCfuuCfaCfaGfgsAfsa | | | | |
| D1683 | 701 | S1683 | CfcUfgUfgAfaAfaGfgCfcAfcUfuUfuCfaUfL96 | 1793 | AS1683 | aUfgAfaaaGfuGfccUfuuCfaCfaGfgsAfsa | | | | |
| D1684 | 702 | S1684 | CfuUfgUfaAfaGfgCfcAfcUfuUfuCfaAfuUfL96 | 1794 | AS1684 | aAfuGfaAfaAfaFfuGfccUfuUfcAfcAfgsGfsa | | | | |
| D1685 | 703 | S1685 | CfuUfgUfaAfaGfgCfcAfcUfuUfUfuucCfaUfuUfL96 | 1795 | AS1685 | aAfuGfaaaAfgcUfuUfcAfcAfgsGfsa | | | | |
| D1686 | 704 | S1686 | UfgUfgAfaAfaGfgCfcAfcUfuUfuuuCfaUfuUfL96 | 1796 | AS1686 | gAfaUfgAfAfAfaFfaGfugcCfuuUfcCfasGfsg | | | | |
| D1687 | 705 | S1687 | UfgUfgAfaAfaGfgCfCfAfcUfuUfuUfCfaUfuUfL96 | 1797 | AS1687 | gAfaUfgaaAfaGfugcCfuUfcCfasGfsg | | | | |
| D1688 | 706 | S1688 | GfaAfaAfgGfcCfAfCfuUfuucauUfcCfcCfL96 | 1798 | AS1688 | gGfaAfuGfAfAfafugcCfuUfuUfcAfcsAfsg | | | | |
| D1689 | 707 | S1689 | GfaAfaAfgGfcCfaCfUfuUfuUfcAfuUfCfcCfL96 | 1799 | AS1689 | gGfaAfuGfAfAfafgugCfcUfuUfuCfAfcsAfsg | | | | |
| D1690 | 708 | S1690 | UfgAfaAfgGfcAfcCfuFfuufucaUfuCfcAfL96 | 1800 | AS1690 | uGfgAfaUfGfAfaAfafaguCfcUfuUfcfasCfsa | | | | |
| D1691 | 709 | S1691 | UfgAfaAfgGfcAfcCfuFfUfufcauCffaCfAfL96 | 1801 | AS1691 | uGfgAfaugAfaAfaguGfcCfuUfuCfasCfsa | | | | |
| D1692 | 710 | S1692 | GfaAfaGfgCfaCfUfuUfuFcauUfCfAfuUfcCfaCfL96 | 1802 | AS1692 | gUfgGfaAfuGfGfaAfaagUfgCfcUfuUfcAfcsAfsc | | | | |
| D1693 | 711 | S1693 | GfaAfaGfgCfaCfUfuUfuUfcauuCfAfuUfcCfaCfL96 | 1803 | AS1693 | gUfgGfaauGfaAfaagUfgCfcUfuUfcsAfsc | | | | |
| D1694 | 712 | S1694 | AfaAfgGfcAfcUfuUfuCfAfuuCfcAfuUfcCfL96 | 1804 | AS1694 | aGfgAfaUfGfAfaaaUfgAfaagGfccCfuUfusCfsa | | | | |
| D1695 | 713 | S1695 | AfaAfgGfcAfcUfuUfuCfaUfuCfcAfuUfcCfL96 | 1805 | AS1695 | aGfgAfauGfaaaAfgAfaAfaGfuGfcCfuuUfusCfsa | | | | |
| D1696 | 714 | S1696 | AfaGfgCfaCfuUfuUfuCfaUfuuCfaFuUfcCfuUfL96 | 1806 | AS1696 | aAfgUfgAfAfAfaGfaaaAfgUfgCfcUfufusCfsc | | | | |

TABLE 1-continued

RNAi Agents and Results of In Vitro Screening

| Duplex ID | SEQ ID NO: | s ID | Sense strand (S) | SEQ ID NO: | AS ID | Antisense strand (AS) | % of mRNA remained conc. of siRNA 1 nM | 0.1 nM | 0.01 nM | IC50 (nM) |
|---|---|---|---|---|---|---|---|---|---|---|
| D1697 | 715 | S1697 | AfaGfgCfcCfuUfUfCfaUfcCfafuUfCfCfacCfuUfL96 | 1807 | AS1697 | aAfgUfggaAfuGfaaaAfgUfgCfcUfusUfsc | | | | |
| D1698 | 716 | S1698 | AfgGfcAfcUfuUfUfCfaUfuccAfcUfuUfL96 | 1808 | AS1698 | aAfaGfuGfgAfaUfgaaAfaGfuGfcCfusUfsu | | | | |
| D1699 | 717 | S1699 | AfgGfcAfcUfuUfUfCfaUfuCfCfAfcUfuUfUfL96 | 1809 | AS1699 | aAfaGfuggAfaUfgaaAfaGfuGfccCfusUfsu | | | | |
| D1700 | 718 | S1700 | GfgcCfaCfuUfuUfCfAfaUfccacCfuUfaUfL96 | 1810 | AS1700 | uAfaAfgUfgGfaAfugaAfaAfgUfgCfcsUfsu | | | | |
| D1701 | 719 | S1701 | GfgcCfaCfuUfuUfCfAfaUfcCfAfCfuUfaAfL96 | 1811 | AS1701 | uAfaAfgugGfaAfugaAfaAfgUfgCfcsUfsu | | | | |
| D1702 | 720 | S1702 | GfcAfcUfuUfuCfAfUfuCfcaCfuUfaAfL96 | 1812 | AS1702 | uUfaAfaGfUfGfAfugaAfaAfaGfuGfcsCfsu | | | | |
| D1703 | 721 | S1703 | GfcAfcUfuUfuCfAfUfuCfcacucAfuUfaAfL96 | 1813 | AS1703 | uUfaAfaguGfAfauGfAfaAfaGfuGfcsCfsu | | | | |
| D1704 | 722 | S1704 | CfaCfuUfuCfAfUfUfcCfacuUfaCfL96 | 1814 | AS1704 | gUfUfaAfgUfUfgGfaauGfaaAfaAfgUfgsCfsc | | | | |
| D1705 | 723 | S1705 | CfaCfuUfuCfAfUfUfcCfaCfuUfaCfL96 | 1815 | AS1705 | gUfUfaagUfgGfaaUfGfaaAfaAfgUfgsCfsc | | | | |
| D1706 | 724 | S1706 | AfcUfuUfcfaUfcCfAfcfuuUfaAfcUfL96 | 1816 | AS1706 | aGfUfaAfAfGfgaaUfgGfaaAfUfgAfaAfaGfusGfsc | | | | |
| D1707 | 725 | S1707 | AfcUfuUfcfaUfcCfAfUfuUfaAfcUfL96 | 1817 | AS1707 | aGfUfaaaAfgGfaaUfGfaaAfUfgAfaAfaGfusGfsc | | | | |
| D1708 | 726 | S1708 | CfuUfUfCfaUfcCfAfCfuuuAfaCfuUfL96 | 1818 | AS1708 | aAfgUfAfAfAfgUfggaAfuGfaaAfaAfgUfsg | | | | |
| D1709 | 727 | S1709 | CfuUfUfCfAfUfuCfCfacuUfaAfcUfuGfL96 | 1819 | AS1709 | aAfgUfuaaAfgUfggaAfuGfaAfaAfasGfsg | | | | |
| D1710 | 728 | S1710 | UfUfUfCfaUfuCfCfAfuUfuaaAfcUfuGfL96 | 1820 | AS1710 | cAfaGfuUfAfAfAfaGfuggaAfuGfAfaAfasGfsu | | | | |
| D1711 | 729 | S1711 | UfUfUfCfAfuUfcCfAfCfuUfAfAfAfcUfuGfaAfL96 | 1821 | AS1711 | cAfaGfuuaAfaGfuggAfuGfAfaAfAfasGfsg | | | | |
| D1712 | 730 | S1712 | UfUfUfcAfuUfcCfAfCfuUfuAfacCfuUfgAfL96 | 1822 | AS1712 | uCfaAfgUfUfAfAfAfgugGfaAfuGfaAfasAfsg | | | | |
| D1713 | 731 | S1713 | UfUfUfCfAfUfuCfCfAfCfuUfuAfAfCfuUfgAfL96 | 1823 | AS1713 | uCfaAfguuAfaAfguGfaAfuGfaAfasAfsg | | | | |
| D1714 | 732 | S1714 | UfUfCfaUfUfcCfAfCfUfuUfaaCfuUfgAfL96 | 1824 | AS1714 | aUfCfaAfgUfUfAfaAfaguGfaAfuGfAfasAfsa | | | | |
| D1715 | 733 | S1715 | UfUfCfaUfUfcCfAfCfuUfuAfAfCfuUfgAfL96 | 1825 | AS1715 | aUfcAfaguUfaAfaGfAfaUfGfAfasAfsa | | | | |
| D1716 | 734 | S1716 | UfcAfuUfcCfaCfUfuUfaAfcUfuGfaAfL96 | 1826 | AS1716 | aAfuCfAfaGfUfUfaAfaaguUfgGfaAfuGfasAfsa | | | | |
| D1717 | 735 | S1717 | UfcAfuUfCfaCfUfUfuAfaCfuUfgAfuUfL96 | 1827 | AS1717 | aAfuCfaagUfuAfaagUfgGfaAfuGfasAfsa | | | | |
| D1718 | 736 | S1718 | CfaUfcCfAfcfuUfuAfaCfuuGfaAfuUfL96 | 1828 | AS1718 | aAfaUfCfAfGfuUfaaaGfuGfAfaUfgAfsa | | | | |

TABLE 1-continued

RNAi Agents and Results of In Vitro Screening

| Duplex ID | S ID | SEQ ID NO: | Sense strand (S) | AS ID | SEQ ID NO: | Antisense strand (AS) | % of mRNA remained conc. of siRNA 1 nM | 0.1 nM | 0.01 nM | IC50 (nM) |
|---|---|---|---|---|---|---|---|---|---|---|
| D1719 | S1719 | 737 | CfaUfcCfaAfcUfUfFfaAfcUfUfGfaUfuUfL96 | AS1719 | 1829 | aAfaUfcaaGfuUfaaGfuGfgAfaUfgsAfsa | | | | |
| D1720 | S1720 | 738 | AfuUfcCfaCfuUfAfaCfuugAfuFfuUfL96 | AS1720 | 1830 | aAfaAfucFfaAfgUfuaaAfgUfgGfaAfusGfsa | | | | |
| D1721 | S1721 | 739 | AfuUfcCfacCfuUfAfaCfuUfGfaFfuUfuUfL96 | AS1721 | 1831 | aAfaAfaAfucaAfgUfuaaAfgUfgGfaAfasGfsa | | | | |
| D1722 | S1722 | 740 | UfuCfcAfCfuUfAfaFfcCfufgaUfuUfuUfL96 | AS1722 | 1832 | aAfaAfaAfuFfCfAfaGfuuaAfagUfaGfuGfgAfasUfsg | | | | |
| D1723 | S1723 | 741 | UfuCfcAfCfuUfAfaCfuFfgAfcUfufuUfuUfL96 | AS1723 | 1833 | aAfaAfaAfauCfaGfuuaAfaGfaGfuGfgAfasUfsg | | | | |
| D1724 | S1724 | 742 | UfcCfcaCfuUfaAfcFfuFfgauUfuUfuUfL96 | AS1724 | 1834 | aAfaAfaAfuFfCfaAfguuAfaFfgUfgGfasAfsu | | | | |
| D1725 | S1725 | 743 | UfcCfaCfuUfuAfaCfuUfgFfauuUfuUfuUfAfL96 | AS1725 | 1835 | aAfaAfaauCfaAfguuAfaAfgUfgGfasAfsu | | | | |
| D1726 | S1726 | 744 | CfcAfcUfuaCfUfuFfugFfauuUfuUfuAfL96 | AS1726 | 1836 | uAfaAfafaAfuCfAfAfguUfaAfaGfuGfgsAfsa | | | | |
| D1727 | S1727 | 745 | CfcAfcUfuAfaCfUfuFfuGfAfuUfuUfuAfL96 | AS1727 | 1837 | uAfaAfafaAfaaaUfCfAfaguUfaAfaGfuGfgsAfsa | | | | |
| D1728 | S1728 | 746 | CfaCfuUfuaaCfUfuFfgAfuuuUfuAfaAfL96 | AS1728 | 1838 | uUfaAfaAfaaaUfuCfaagUfuAfaAfgUfgsGfsa | | | | |
| D1729 | S1729 | 747 | CfaCfuUfuAfacCfUfuFfgAfuUfuUfaaAfL96 | AS1729 | 1839 | uUfaAfaAfaaaAfuCfaagUfuAfaAfgUfgsGfsa | | | | |
| D1730 | S1730 | 748 | AfcUfuFfaAfcUfGfaUfuUfuauUfaAfaAfL96 | AS1730 | 1840 | uUfuAfaAfaAfAfAfuCfaaGfuUfaAfaGfusGfsg | | | | |
| D1731 | S1731 | 749 | AfcUfuAfaCfUfGfaUfuFfGfAfuUfuuuAfaAfaAfL96 | AS1731 | 1841 | uUfuAfaaAfaAfaAfaUfcaaGfuUfaAfaGfsFsg | | | | |
| D1732 | S1732 | 750 | CfuUfaAfacFfuFfGfAfuUfuuuAfaAfaAfL96 | AS1732 | 1842 | aUfuUfaAfaAfAfAfAfucAfgUfuAfaAfgsUfsg | | | | |
| D1733 | S1733 | 751 | CfuUfaAfcFfuGfFfAfuUfuUfuAfaAfaAfL96 | AS1733 | 1843 | aUfuUfaaaAfaAfaucaAfgUfuAfaAfgsUfsg | | | | |
| D1734 | S1734 | 752 | UfuUfaAfcFfuGfAfUfuFfuuuAfaAfaAfL96 | AS1734 | 1844 | aAfuUfaAfAfAfAfaucAfaGfuUfaAfasGfsu | | | | |
| D1735 | S1735 | 753 | UfuFfaAfcFfuFfgAfUfuFfuUfuAfaAfaAfuUfL96 | AS1735 | 1845 | aAfuUfaaAfaAfaaucAfaGfuUfaAfasGfsu | | | | |
| D1736 | S1736 | 754 | UfuAfaCfuFfgAfFfuFfuuuAfaaAfaAfuCfL96 | AS1736 | 1846 | gAfuUfuuaAfaAfaaucUfaAfgUfuAfasAfsg | | | | |
| D1737 | S1737 | 755 | UfuAfaCfuFfgAfFfuFfuuaAfaAfuCfL96 | AS1737 | 1847 | gAfaUfuuaAfaAfaaucfaAfgUfuAfasAfsg | | | | |
| D1738 | S1738 | 756 | UfaAfcFfuGfaUfuFfuaaAfAfAfaUfcCfL96 | AS1738 | 1848 | gGfaAfuFfuaaAfaAfCfaGfuUfaAfasAfsa | | | | |
| D1739 | S1739 | 757 | UfaAfcFfuGfaUfuFfuaAfAfAfaAfuCfCfL96 | AS1739 | 1849 | gGfaAfuuuAfaAfaaaUfCfaGfuUfaAfasAfsa | | | | |
| D1740 | S1740 | 758 | AfaCfuGfAfuUfUfUfFfaAfaaaUfcCfCfL96 | AS1740 | 1850 | gGfgAfauUfaAfaAfaAfgUfusAfsa | | | | |
| D1741 | S1741 | 759 | AfaCfuCfuFfgaUfuFfuuAfaFfaAfuCfaFfcCfL96 | AS1741 | 1851 | gGfgAfauuUfaAfaAfaAfucFfaAfgUfusAfsa | | | | |

TABLE 1-continued

RNAi Agents and Results of In Vitro Screening

| Duplex ID | s ID | SEQ ID NO: | Sense strand (S) | AS ID | SEQ ID NO: | Antisense strand (AS) | % of mRNA remained conc. of siRNA | | | IC50 (nM) |
|---|---|---|---|---|---|---|---|---|---|---|
| | | | | | | | 1 nM | 0.1 nM | 0.01 nM | |
| D1742 | S1742 | 760 | AfcUfuGfaUfuUfuUfuUfuUfAfaauUfcCfcUfL96 | AS1742 | 1852 | aGfgGfaAfuUfUfuAfaaaAfuUfcAfaGfusUfsa | | | | |
| D1743 | S1743 | 761 | AfcUfuGfaUfuUfuUfuUfuUfAfaaaAfuUfcCfcUfL96 | AS1743 | 1853 | aGfgGfaauUfuAfaaaAfaUfcAfaGfusUfsa | | | | |
| D1744 | S1744 | 762 | CfuUfgAfuUfuUfuUfuUfAfaauUfcCfcUfL96 | AS1744 | 1854 | aAfgGfgAfAfUfuUfaaaAfaAfuCfaAfgsUfsu | | | | |
| D1745 | S1745 | 763 | CfuUfgAfuUfuUfuUfuUfAfaaaAfuUfcCfcUfuUfL96 | AS1745 | 1855 | aAfgGfgaaUfuUfaaaAfaAfuCfaAfgsUfsu | | | | |
| D1746 | S1746 | 764 | UfuUfgAfuUfuUfuUfAfaAfaAfuUfuccCfcUfuAfL96 | AS1746 | 1856 | uAfaGfgGfAfAfuUfuaaAfaAfaUfcAfcAfasGfsu | | | | |
| D1747 | S1747 | 765 | UfuGfaUfuUfuUfuUfAfaAfaAfuUfcCfcUfuUfaUfL96 | AS1747 | 1857 | uAfaGfgaAfuUfuaaaAfaAfaAfuCfasAfsu | | | | |
| D1748 | S1748 | 766 | UfgAfuUfuUfuUfuUfAfaAfaAfuCfuccCfuUfaUfL96 | AS1748 | 1858 | aUfaAfgGfGfaUfuuaaAfaAfaAfaUfcfasAfsg | | | | |
| D1749 | S1749 | 767 | UfgAfuUfuUfuUfuUfAfaAfaAfuUfuCfcUfuUfaUfL96 | AS1749 | 1859 | aUfaAfgggAfaUfuuaaAfaAfaAfuCfasAfsg | | | | |
| D1750 | S1750 | 768 | GfaUfuUfuUfuUfAfaAfaAfuUfuCfcUfuUfaUfL96 | AS1750 | 1860 | aAfuAfgGfGfaAfuuuaAfaAfaAfuCfsAfsa | | | | |
| D1751 | S1751 | 769 | GfaUfuUfuUfuUfAfaAfaAfuUfuccCfuUfaUfuUfaAfL96 | AS1751 | 1861 | aAfuAfaggGfaAfuuuAfaAfaAfuUfcsAfsa | | | | |
| D1752 | S1752 | 770 | AfuUfuUfuUfAfaAfaAfuUfuCfccuUfaUfuGfL96 | AS1752 | 1862 | cAfaUfaAfGfGfaAfuUfuaaAfaAfaUfusCfsa | | | | |
| D1753 | S1753 | 771 | AfuUfuUfuAfaAfaAfuUfuCfcUfuUfaUfuGfL96 | AS1753 | 1863 | cAfaUfaagGfaAfauuUfaAfaAfaAfusCfsa | | | | |
| D1754 | S1754 | 772 | UfuUfuUfaAfaAfuUfuCfcUfuuaUfuGfuUfL96 | AS1754 | 1864 | aCfaAfuaAfgGfaaUfuUfaAfaAfaAfasUfsc | | | | |
| D1755 | S1755 | 773 | UfuUfuUfaAfaAfuUfuCfcUfuaUfuGfuUfL96 | AS1755 | 1865 | aCfaAfuaaAfgGfaaUfuUfaAfaAfaAfasAfsu | | | | |
| D1756 | S1756 | 774 | UfuUfuAfaAfaAfuUfuCfcUfuuaUfuGfuUfgUfL96 | AS1756 | 1866 | gAfcAfaUfAfAfgGfgaaUfuAfaAfaAfasAfsu | | | | |
| D1757 | S1757 | 775 | UfuUfuAfaAfaAfuUfuCfcUfuauUfuGfuCfL96 | AS1757 | 1867 | gAfcAfaauaAfgGfgaaUfuUfaAfaAfasCfsa | | | | |
| D1758 | S1758 | 776 | UfuUfaAfaAfuUfuCfcUfuauUfuGfuCfcCfL96 | AS1758 | 1868 | gGfaCfaAfuAfAfgGfgaAfuUfuAfaAfasAfsa | | | | |
| D1759 | S1759 | 777 | UfuUfaAfaAfuUfuCfcUfuaUfuGfuCfcCfL96 | AS1759 | 1869 | gGfaCfaauaAfgGfggAfuUfuAfaAfasAfsa | | | | |
| D1760 | S1760 | 778 | UfuUfaAfaAfuUfcCfcUfuuaUfuGfuCfcCfL96 | AS1760 | 1870 | gGfgAfcCfAfAfuUfaAfgggAfuUfuAfaAfasAfsa | | | | |
| D1761 | S1761 | 779 | UfuUfaAfaAfuUfcCfcUfuugUfuGfuCfcCfL96 | AS1761 | 1871 | gGfgAfcaaUfaAfggAfuUfuAfaAfasAfsa | | | | |
| D1762 | S1762 | 780 | UfuUfaAfaAfuUfcCfcUfuCfUfuGfuCfcCfL96 | AS1762 | 1872 | aGfgGfaCfAfAfuAfaggGfaAfuUfuAfaAfasAfsa | | | | |
| D1763 | S1763 | 781 | UfuAfaAfuUfcCfcUfuCfUfuGfuCfcCfcUfL96 | AS1763 | 1873 | aGfgGfacaAfuAfaggGfaAfuUfuAfasAfsa | | | | |

TABLE 1-continued

RNAi Agents and Results of In Vitro Screening

| Duplex ID | s ID | SEQ ID NO: | Sense strand (S) | AS ID | SEQ ID NO: | Antisense strand (AS) | % of mRNA remained conc. of siRNA | | | IC50 (nM) |
|---|---|---|---|---|---|---|---|---|---|---|
| | | | | | | | 1 nM | 0.1 nM | 0.01 nM | |
| D1764 | S1764 | 782 | UfaAfaAfcfcCfuCfuFufuguCfcCfuUfL96 | AS1764 | 1874 | aAfgGfaAfcFcAfaUfaagGfaAfaUfaaUfasAfsa | | | | |
| D1765 | S1765 | 783 | UfaAfaAfuFcCfcCfuUfaUfuFuFuFcCfcCfuUfL96 | AS1765 | 1875 | aAfgGfgacAfaUfaagGfgAfaAfuUfUfasAfsa | | | | |
| D1766 | S1766 | 784 | AfaAfaAfuFcCfcUfaUfAfaUfFuGfuCfcUfcCfL96 | AS1766 | 1876 | gAfaGfgAfGfGfaAfcFaAfuaaGfgGfaAfuUfusAfsa | | | | |
| D1767 | S1767 | 785 | AfaAfaAfuFcCfcUfuUfaUfAfuFuGfuCfcCfuFcCfL96 | AS1767 | 1877 | gAfaGfggaCfaAfuaaGfgaAfuFusAfsa | | | | |
| D1768 | S1768 | 786 | AfaAfuFcFcCfcUfuFaUfuGfucCfuUfCcCfL96 | AS1768 | 1878 | gGfaAfgGfgAfcAfcAfauaAfgGfaAfuFusUfsa | | | | |
| D1769 | S1769 | 787 | AfaUfuFcFcCfcUfaFaUfuFuFuFcCfcCfuUfcCfL96 | AS1769 | 1879 | gGfaAfgggAfcAfauaAfgGfgAfaUfusUfsa | | | | |
| D1770 | S1770 | 788 | AfuUfcCfcCfuFaAfuFuFuGfuCfcccUfCfaAfL96 | AS1770 | 1880 | uGfgAfaGfGfGfacFaauAfaGfgGfaAfusUfsu | | | | |
| D1771 | S1771 | 789 | AfuUfcCfcCfuFuAfuFuFuGfuCfcCfuUfcCfaAfL96 | AS1771 | 1881 | uGfgAfaggGfaCfaauAfaGfgGfaAfusUfsu | | | | |
| D1772 | S1772 | 790 | UfuCfcCfcFuUfaUfaFuFuGfuCfcCfcuUfcAfL96 | AS1772 | 1882 | uUfgGfaAfgGfGfaAfgFaAfcaaUfaAfgGfaAfasUfsu | | | | |
| D1773 | S1773 | 791 | UfuCfcCfuFuAfuUfaFuFuGfuCfcCfaAfL96 | AS1773 | 1883 | uUfgGfaagGfaAfcAfcaaUfaAfgGfgAfusUfsu | | | | |
| D1774 | S1774 | 792 | UfcCfcCfuFaAfuFaFuFuGfuGfcCfcuUfcAfaAfL96 | AS1774 | 1884 | uUfgGfAfAfGfgGfacaAfuAfaGfGfaaAfsu | | | | |
| D1775 | S1775 | 793 | UfcCfcCfuAfuFaUfuFuFuGfcCfCfaAfaAfAfL96 | AS1775 | 1885 | uUfUfgGfgaaGfgFacaAfuAfaGfgGfasAfsa | | | | |
| D1776 | S1776 | 794 | CfcCfuFaFuFuGfuCfCfcfuuCfaAfaAfAfL96 | AS1776 | 1886 | uUfuUfgGfAfAfGfgacAfaUfaAfgGfgsAfsa | | | | |
| D1777 | S1777 | 795 | CfcCfuFaUfuGfuCfcCfuUfcCfaaAfAfAfL96 | AS1777 | 1887 | uUfuUfggaAfgGfacaAfaUfaAfgGfgAfsa | | | | |
| D1778 | S1778 | 796 | CfcUfaUfaUfugUfCfcCfcUfuccUfaaAfAfAfL96 | AS1778 | 1888 | uUfuUfuFgGfaAfaGfGfgaCfaAfuAfaGfgsGfsa | | | | |
| D1779 | S1779 | 797 | CfcUfaUfaUfugUfCfcUfcCfaAfaAfAfAfL96 | AS1779 | 1889 | uUfuUfuggAfaGfGfgaCfaAfuAfaGfgsGfsa | | | | |
| D1780 | S1780 | 798 | CfuUfaUfaUfuFgUfCfcUfccaAfaAfAfAfAfL96 | AS1780 | 1890 | uUfuUfuFuGfGfaAfgggAfcAfaUfaAfgsGfsg | | | | |
| D1781 | S1781 | 799 | CfuUfaUfaUfugUfCfcUfuCfcAfaAfAfAfAfL96 | AS1781 | 1891 | uUfuUfuugGfaAfgggAfcAfaUfaAfgsGfsg | | | | |
| D1782 | S1782 | 800 | UfuAfuaUfuGfcCfcFcFcUfucCfaaAfaAfAfAfL96 | AS1782 | 1892 | uUfuUfuUfuFgGfAfaggGfaCfaAfuAfaGfsg | | | | |
| D1783 | S1783 | 801 | UfuUfaUfuGfuCfcUfcCfaAfaFaAfAfAfAfL96 | AS1783 | 1893 | uUfUfuUfuuuGfAfaggGfaCfaAfuAfaFasGfsg | | | | |
| D1784 | S1784 | 802 | UfaUfaUfuGfcCfcCfuUfCfcFaaAfaAfAfAfAfAfL96 | AS1784 | 1894 | uUfuUfuUfuFuFgGfaagGfFaAfcAfaUfaUfasAfsg | | | | |
| D1785 | S1785 | 803 | UfaUfaUfuFgUfcCfcCfuUfCfcFaaaAfaAfAfAfAfL96 | AS1785 | 1895 | uUfuUfuuuuFgGfaagGfaAfcAfaUfasAfsg | | | | |
| D1786 | S1786 | 804 | AfuUfgUfcCfcFcFuUfcCfaFaaaAfAfaGfL96 | AS1786 | 1896 | cUfuUfuUfuFuGfgaaGfgFacCfaAfuFasAfsa | | | | |

TABLE 1-continued

RNAi Agents and Results of In Vitro Screening

| Duplex ID | S ID | SEQ ID NO: Sense strand (S) | AS ID | SEQ ID NO: Antisense strand (AS) | % of mRNA remained conc. of siRNA | | | IC50 (nM) |
|---|---|---|---|---|---|---|---|---|
| | | | | | 1 nM | 0.1 nM | 0.01 nM | |
| D1787 | S1787 | 805 AfuUfgUfcCfcUfUfCfCfAfaAfAfAfaGfL96 | AS1787 | 1897 cUfuUfuuuUfuGfgaaGfgGfaCfaAfusAfsa | | | | |
| D1788 | S1788 | 806 UfuGfuCfcCfuUfCfCfaAfaaaAfaAfgAfL96 | AS1788 | 1898 uCfuUfuUfUfuUfgaAfgGfgAfcAfasUfsa | | | | |
| D1789 | S1789 | 807 UfuGfuCfcCfuUfCfCfaAfaAfAfaAfgGfL96 | AS1789 | 1899 uCfuUfuuUfuUfgGfaAfgGfgAfcAfasUfsa | | | | |
| D1790 | S1790 | 808 UfgUfcCfcUfuCfCfaAfaAfAfaGfaGfL96 | AS1790 | 1900 cUfcUfuUfUfuUfuggAfaGfgGfaCfasAfsu | | | | |
| D1791 | S1791 | 809 UfgUfcCfcUfuCfCfaAfAfAfaGfaGfL96 | AS1791 | 1901 cUfcUfuuuUfuUfuggAfaGfgGfaCfasAfsu | | | | |
| D1792 | S1792 | 810 GfuCfcCfuUfcCfCfaAfAfaAfaaAfgAfL96 | AS1792 | 1902 uCfuCfuUfUfUfUfuugGfaAfgGfAfcsAfsa | | | | |
| D1793 | S1793 | 811 GfuCfcCfuUfcCfCfaAfAfAfaaaGfaAfL96 | AS1793 | 1903 uCfuCfuuuUfuUfuugGfaAfgGfaAfgsCfsa | | | | |
| D1794 | S1794 | 812 UfcCfcUfuCfcCfAfAfAfAfaaaGfaGfL96 | AS1794 | 1904 uUfCfUfCfUfUfUfuuUfgUfaAfgGfgGfasCfsa | | | | |
| D1795 | S1795 | 813 UfcCfcUfuCfcCfAfAfAfAfaGfaGfAfL96 | AS1795 | 1905 uUfcUfUfcUfUfUfuuUfgUfaAfgGfgAfasGfsa | | | | |
| D1796 | S1796 | 814 CfcCfuUfCfccfAfAfAfAfaagAfgAfUfL96 | AS1796 | 1906 aUfcUfucUfcUfUfUfuuuUfgGfaAfgGfgsAfsc | | | | |
| D1797 | S1797 | 815 CfcCfuUfCfcAfAfAfAfAfagaAfgAfUfL96 | AS1797 | 1907 aUfcUfcucUfuUfuUfcUfuuuUfgGfaAfgsGfsc | | | | |
| D1798 | S1798 | 816 CfCfuCfaAfAfAfAfafagaGfaAfiuCfL96 | AS1798 | 1908 gAfuUfcUfCfUfCfUfuUfuuuUfgAfaGfgsGfsa | | | | |
| D1799 | S1799 | 817 CfcUfcCfaAfAfAfAfAfagAfgAfgaAfuCfL96 | AS1799 | 1909 gAfuUfcUfcucUfuUfuuuUfcUfuuuUfgAfAfgsGfsg | | | | |
| D1800 | S1800 | 818 CfcUfcCfAfAfAfAfAfagAfgAfUfcAfL96 | AS1800 | 1910 uGfaUfcUfCfUfcUfuuuUfuUfGfgAfAfgsGfsg | | | | |
| D1801 | S1801 | 819 CfcUfcCfAfAfAfAfAfaAfgGfaAfUfcAfL96 | AS1801 | 1911 uGfaUfcuCfuUfcUfcUfuuuUfUfgGfaAfgsGfsg | | | | |
| D1802 | S1802 | 820 UfuCfcAfAfAfaAfaaAfgAfgAfauCfaAfL96 | AS1802 | 1912 UfgAfUfcUfCfUfCfUfuuuUfUfuGfgAfAfgsGfsg | | | | |
| D1803 | S1803 | 821 UfuCfcAfAfAfaAfaAfAfgGfaUfcAfAfL96 | AS1803 | 1913 uUfgAfUfuCfuCfUfcUfUfUfUfuGfgAfAfgsGfsg | | | | |
| D1804 | S1804 | 822 UfcCfaAfAfaAfAfaAfgAfgAfgaaUfcAfL96 | AS1804 | 1914 uUfgAfUfUfCfuCfuuuUfUfUfuUfgGfaAfsGfsg | | | | |
| D1805 | S1805 | 823 UfcCfaAfAfAfaAfaAfgGfaAfuCfAfAfL96 | AS1805 | 1915 uUfuGfauuCfuCfuuuUfUfUfuGfgAfasAfsg | | | | |
| D1806 | S1806 | 824 CfcAfaAfAfAfaAfAfgGfaAfuCfaAfAfL96 | AS1806 | 1916 uUfuGfAfUfUfCfuUfcUfUfUfUfuGfuGfAfsa | | | | |
| D1807 | S1807 | 825 CfcAfaAfAfAfaAfAfgGfaAfUfcAfaAfL96 | AS1807 | 1917 uUfuUfgauUfcUfcuuUfuUfUfuGfgsAfsa | | | | |
| D1808 | S1808 | 826 CfaaAfAfAfaAfAfgGfAfgGfaucAfaAfAfUfL96 | AS1808 | 1918 aUfuUfgAfUfucUfucUfuUfuUfuFfgsGfsa | | | | |

TABLE 1-continued

RNAi Agents and Results of In Vitro Screening

| Duplex ID | S ID | SEQ ID NO: | Sense strand (S) | AS ID | SEQ ID NO: | Antisense strand (AS) | % of mRNA remained conc. of siRNA | | | IC50 (nM) |
|---|---|---|---|---|---|---|---|---|---|---|
| | | | | | | | 1 nM | 0.1 nM | 0.01 nM | |
| D1809 | S1809 | 827 | CfaAfaAfaAfaAfgAfgAfgAfaUfCfAfaAfaAfuUfL96 | AS1809 | 1919 | aUfuGfugaUfuCfucuUfuUfuUfuUfgsGfsa | | | | |
| D1810 | S1810 | 828 | AfaAfaAfaAfaAfgAfgAfgGfgaAfucaAfaAfiuUfL96 | AS1810 | 1920 | aAfuUfuUfgAfAfuUfcucUfuUfuUfuUfusGfsg | | | | |
| D1811 | S1811 | 829 | AfaAfaAfaAfgAfgAfgAfgGfaAfaAfuCfAfaAfaUfL96 | AS1811 | 1921 | aAfuUfuUfuugAfuUfcucUfuUfuUfuUfusGfsg | | | | |
| D1812 | S1812 | 830 | AfaAfaAfaAfgAfgGfaAfaAfucaaAfaAfuUfuUfL96 | AS1812 | 1922 | aAfuAfuUfuUfGfAfucuCfuUfuUfuUfusUfsg | | | | |
| D1813 | S1813 | 831 | AfaAfaAfaAfgAfgAfgGfaAfaAfuUfCfAfaAfaUfL96 | AS1813 | 1923 | aAfaAfuUfuuuGfaUfucuCfuUfuUfuUfusGfsg | | | | |
| D1814 | S1814 | 832 | AfaAfaAfaAfgGfaAfaAfuCfaaaAfuUfuUfuUfL96 | AS1814 | 1924 | aAfaAfaAfuUfUfgAfuucCfuUfuUfuUfusUfsu | | | | |
| D1815 | S1815 | 833 | AfaAfaAfaAfgGfaAfAfuUfCfaAfaAfuUfuAfL96 | AS1815 | 1925 | aAfaAfuuuUfgAfuccUfcUfuUfuUfusUfsu | | | | |
| D1816 | S1816 | 834 | AfaAfaAfaAfgAfgfgAfgAfAfUfCfAfaaaUfuAfL96 | AS1816 | 1926 | uAfaAfaAfuUfUfuGfauuCfcuUfuUfusUfsu | | | | |
| D1817 | S1817 | 835 | AfaAfaAfaAfgAfgaAfgAfAfUfCfAfAfaAfuUfuAfL96 | AS1817 | 1927 | uAfaAfaAfauuuUfuGfauuCfcUfuUfusUfsu | | | | |
| D1818 | S1818 | 836 | AfaAfaAfgAfgaAfgAfaUfCfAfaAfaAfaauuUfaCfL96 | AS1818 | 1928 | gUfaAfaAfaUfUfUfgauUfcUfcUfuUfusUfsu | | | | |
| D1819 | S1819 | 837 | AfaAfaAfgAfgaAfgAfaUfCfAfAfaAfaAfauUfaCfL96 | AS1819 | 1929 | gUfaAfaAfauuUfuUfgauUfcUfcUfuUfusUfsu | | | | |
| D1820 | S1820 | 838 | AfaAfgAfgAfgaAfgAfaUfCfAfAfaAfaAfaauUfaCfAfL96 | AS1820 | 1930 | uGfuAfaAfaAfUfuUfugaUfcUfcUfuUfusUfsu | | | | |
| D1821 | S1821 | 839 | AfaAfgAfgAfgAfgaAfgAfAfUfCfAfAfaAfaAfuCfAfL96 | AS1821 | 1931 | uGfuAfaaaUfuUfugaUfcUfcUfuUfusUfsu | | | | |
| D1822 | S1822 | 840 | AfaGfaGfaGfaAfuCfaAfAfaAfaAfaUfuuuCfaCfaAfL96 | AS1822 | 1932 | uUfgUfaAfAfAfuUfuugAfuUfcUfcUfusUfsu | | | | |
| D1823 | S1823 | 841 | AfaGfaGfaGfaAfuCfaAfAfAfaAfaAfuUfuUfuCfaAfAfL96 | AS1823 | 1933 | uUfgUfaaaAfuUfuugAfuUfcUfcUfusUfsu | | | | |
| D1824 | S1824 | 842 | AfgAfaAfgAfcAfAfaAfaAfaAfaUfuuuAfcAfaAfAfL96 | AS1824 | 1934 | uUfuGfuAfaAfAfaUfuuuGfaUfuuGfaUfcUfusUfsu | | | | |
| D1825 | S1825 | 843 | AfgAfgAfgAfuCfAfAfaAfuUfuUfuUfuAfAfcAfaAfL96 | AS1825 | 1935 | uUfuGfuaaAfaAfuUfuuuGfaUfuCfuCfusUfsu | | | | |
| D1826 | S1826 | 844 | GfaAfgAfuCfaAfAfaAfAfuUfuuaCfaaCfaAfGfL96 | AS1826 | 1936 | cUfuUfgUfAfAfAfuuuCfuAfuUfcUfcsUfsu | | | | |
| D1827 | S1827 | 845 | AfaGfaGfuCfaAfuCfaAfAfAfuUfuUfuUfaCfaaAfAfL96 | AS1827 | 1937 | cUfuUfgUfuaAfaAfuuuUfgAfuUfcUfcsUfsu | | | | |
| D1828 | S1828 | 846 | AfgAfaAfgCfaAfAfaAfAfAfUfuUfuuaCfaAfaAfL96 | AS1828 | 1938 | uCfuUfgUfgAfaAfaUfuuuUfgGfaUfuCfuCfsu | | | | |
| D1829 | S1829 | 847 | AfgAfgAfgCfAfaAfaAfuCfAfaAfaAfgAfgAfL96 | AS1829 | 1939 | uCfuUfguaAfaAfauuAfuUfgAfuUfcUfcsfsu | | | | |
| D1830 | S1830 | 848 | GfaAfuCfaAfaAfaAfuUfuUfuacaAfaAfgGfaAfL96 | AS1830 | 1940 | uUfcUfuFgUfGfUfaAfauUfgAfuuCfuUfsc | | | | |
| D1831 | S1831 | 849 | GfaAfuCfaAfaAfuUfUfuUfaCfAfaAfgAfaAfL96 | AS1831 | 1941 | uUfcUfuugUfaAfauUfuUfgAfuUfcsUfsc | | | | |

TABLE 1-continued

RNAi Agents and Results of In Vitro Screening

| Duplex ID | S ID | SEQ ID NO: | Sense strand (S) | AS ID | SEQ ID NO: | Antisense strand (AS) | % of mRNA remained conc. of siRNA 1 nM | 0.1 nM | 0.01 nM | IC50 (nM) |
|---|---|---|---|---|---|---|---|---|---|---|
| D1832 | S1832 | 850 | AfaUfcAfaAfaAfuUfUfUfuAfcaaAfgaAfaUfL96 | AS1832 | 1942 | aUfuCfuUfUfgCfuAfaaaUfuUfgGfaUfusCfsu | | | | |
| D1833 | S1833 | 851 | AfaUfcAfaAfaAfuUfUfUfuAfcAfaAfAfgAfaUfL96 | AS1833 | 1943 | aUfuCfuuuGfuAfaaaUfuUfgGfaUfusCfsu | | | | |
| D1834 | S1834 | 852 | AfucCfaAfaAfaAfuUfUfUfuCfaaaGfaAfucCfL96 | AS1834 | 1944 | gAfuUfcCfUfUfgUfaaaAfuUfUfgAfusUfsc | | | | |
| D1835 | S1835 | 853 | AfucCfaAfaAfaAfuUfUfUfuCfaAfaAfGfaaUfcCfL96 | AS1835 | 1945 | gAfuUfcuuUfgUfaaaAfuUfUfgAfusUfsc | | | | |
| D1836 | S1836 | 854 | UfcAfaAfaAfuUfuUfUfcAfcAfaagAfaUfcAfL96 | AS1836 | 1946 | uGfaUfcCfUfUfgUfuaaAfaUfuUfuGfasUfsu | | | | |
| D1837 | S1837 | 855 | UfcAfaAfaAfuUfuUfUfcAfcAfaAfaAfaUfcAfL96 | AS1837 | 1947 | uGfaUfucuUfgUfuaaAfaUfuUfuGfasUfsu | | | | |
| D1838 | S1838 | 856 | CfaAfaAfuUfuUfUfaCfaAfagaAfaAfaUfCfaAfL96 | AS1838 | 1948 | uUfgAfuUfCfUfcUfguaaAfaUfuUfuGfsAfsu | | | | |
| D1839 | S1839 | 857 | CfaAfaAfuUfuUfUfuCfaAfaAfaAfaAfucAfL96 | AS1839 | 1949 | uUfgAfuucUfuUfguaaAfaUfuUfuGfsAfsu | | | | |
| D1840 | S1840 | 858 | AfaAfaUfuUfuUfuAfcAfAfaAfAfgaUfcAfaAfL96 | AS1840 | 1950 | uUfuGfaUfUfcUfuuguAfaAfaUfuUfusGfsa | | | | |
| D1841 | S1841 | 859 | AfaAfaUfuUfuUfuCfaAfAfCfAfAfAfgaUfcAfaAfL96 | AS1841 | 1951 | uUfuGfauuCfuuUfguAfaAfaUfuUfusGfsa | | | | |
| D1842 | S1842 | 860 | AfaAfaUfuUfuUfaCfaAfAfAfgAfaAfaAfaAfL96 | AS1842 | 1952 | cUfuUfgAfUfUfcCfuugUfaAfaAfuUfusUfsg | | | | |
| D1843 | S1843 | 861 | AfaAfaUfuUfuUfaCfAfAfAfAfgAfauCfaAfAfgGfL96 | AS1843 | 1953 | cUfuUfgauUfCfuugUfaAfaAfuUfusUfsg | | | | |
| D1844 | S1844 | 862 | AfaAfuUfuUfuAfcAfAfAfAfgAfauCfAfaAfgGfL96 | AS1844 | 1954 | cCfuUfUfGfAfUfcCfuuuGfuAfaAfAfuUfsUfsu | | | | |
| D1845 | S1845 | 863 | AfaAfuUfuUfuAfcAfAfAfAfgAfaAfgAfaAfL96 | AS1845 | 1955 | cCfuUfUfGfAfUfcCfuuuGfuAfaAfAfuUfsUfsu | | | | |
| D1846 | S1846 | 864 | AfuUfuUfuAfcAfaAfaAfgAfauCfaAfgGfL96 | AS1846 | 1956 | uCfcCfUfUfGfAfUfcCfuuuGfuAfaAfAfasUfsu | | | | |
| D1847 | S1847 | 865 | AfuUfuUfuAfCfaAfAfaAfgAfAfgAfgAfL96 | AS1847 | 1957 | uCfcCfUfuugAfuCfuuuGfuAfaAfAfasUfsu | | | | |
| D1848 | S1848 | 866 | AfuUfuUfaCfaAfaAfgAfaUfcAfaAfgGfL96 | AS1848 | 1958 | uUfcCfUfUfGfAfUfcuuUfgUfaAfAfaUfasUfsu | | | | |
| D1849 | S1849 | 867 | UfUfuUfaCfaAfaAfgAfaUfcAfaAfgGfL96 | AS1849 | 1959 | uUfcCfuuuGfAfucuUfgUfucUfaAfaAfasUfsu | | | | |
| D1850 | S1850 | 868 | UfuUfuAfcAfaAfaAfgAfaAfgGfaAfL96 | AS1850 | 1960 | aUfuCfcUfUfUfGfAfuucCfuUfgUfaAfAfsUfsu | | | | |
| D1851 | S1851 | 869 | UfuUfaCfaAfaAfgAfauCfaaAfgGfaAfL96 | AS1851 | 1961 | aUfuCfcuuUfgAfuucCfuUfgAfuuCfUfsFsu | | | | |
| D1852 | S1852 | 870 | UfuAfcAfaAfaAfgAfaUfCfaAfaAfgGfaAfL96 | AS1852 | 1962 | aAfuUfcCfUfUfgAfuuCfauuCfuUfgAfasAfsa | | | | |
| D1853 | S1853 | 871 | UfuAfcAfaAfaAfgAfAfuCfaAfaGfAfaFuUfL96 | AS1853 | 1963 | aAfuUfccuUfgAfuuCfuUfgAfasAfsa | | | | |

TABLE 1-continued

RNAi Agents and Results of In Vitro Screening

| Duplex ID | S ID | SEQ ID NO: | Sense strand (S) | AS ID | SEQ ID NO: | Antisense strand (AS) | % of mRNA remained conc. of siRNA | | | IC50 (nM) |
|---|---|---|---|---|---|---|---|---|---|---|
| | | | | | | | 1 nM | 0.1 nM | 0.01 nM | |
| D1854 | S1854 | 872 | UfacfaAfaGfaAfUfCfaAfaUfcfaAfagGfAfaUfcUfL96 | AS1854 | 1964 | gAfaAfuCfcFfcUfUfgauUfcUfuUfgUfaaAfsa | | | | |
| D1855 | S1855 | 873 | UfacfaAfaGfaAfUfcfaAfaUfcfaAfagGfcAfaUfcfL96 | AS1855 | 1965 | gAfaAfuccUfuUfgaaUfcUfuUfgUfasAfsa | | | | |
| D1856 | S1856 | 874 | AfcfaAfaGfaAfUfcfaAfaUfcfAfaAfggaAfuUfcUfL96 | AS1856 | 1966 | aGfaAfuUfCfcfcUfugaUfucUfuUfgfusAfsa | | | | |
| D1857 | S1857 | 875 | AfcfaAfaGfaAfcfaAfaUfcfAfaAfgGfAfaAfuUfcUfL96 | AS1857 | 1967 | aGfaAfuucCfuUfugaUfuUfuUfugGfusAfsa | | | | |
| D1858 | S1858 | 876 | CfaaAfaGfaAfuCfaAfaUfcfgAfaaUfucUfuAfL96 | AS1858 | 1968 | uAfgAfaUfUfcCfufuugAfuUfcUfuUfgsUfsa | | | | |
| D1859 | S1859 | 877 | CfaAfaGfaaUfcAfaAfUfUfufucfuAfuAfL96 | AS1859 | 1969 | uAfgAfaauuCfcUfuugAfuUfcUfuUfgsUfsa | | | | |
| D1860 | S1860 | 878 | AfaAfgAfaUfcAfAfAfaUfggGfaauUfcUfaGfL96 | AS1860 | 1970 | cUfaGfaAfUfUfcCfuuuGfaUfcUfuUfusGfsu | | | | |
| D1861 | S1861 | 879 | AfaAfgAfaUfcAfAfAfaUfggGfaAfaAfaGfAfaAfgAfL96 | AS1861 | 1971 | cUfaGfaauUfcCfuuuGfaUfcUfuUfusGfsu | | | | |
| D1862 | S1862 | 880 | AfaAfgAfaUfcCfaAfaUfgGfaAfauuCfuAfgAfL96 | AS1862 | 1972 | uCfuAfgAfAfUfuCfcuuUfgAfuUfcUfusUfsg | | | | |
| D1863 | S1863 | 881 | AfaGfaAfuCfaAfaUfgGfaAfaUfuCfuAfgAfL96 | AS1863 | 1973 | uCfuAfgaaUfuCfcuuUfgAfuUfcUfusUfsg | | | | |
| D1864 | S1864 | 882 | AfgAfaUfCfaAfaUfgGfaAfauUfcUfaGfaAfL96 | AS1864 | 1974 | uUfcUfaGfAfAfuUfccuUfugAfuUfcUfusUfsu | | | | |
| D1865 | S1865 | 883 | AfgAfaUfcAfaAfUfgGfaAfaUfcUfUfUfaGfaAfaAfL96 | AS1865 | 1975 | uUfcUfagaAfuUfccuUfugAfuUfcUfusUfsu | | | | |
| D1866 | S1866 | 884 | GfaaUfcfaAfaGfGfaAfaUfucUfaGfaAfaAfL96 | AS1866 | 1976 | uUfuCfuAfgAfaUfuccUfuUfgAfuUfcsUfsu | | | | |
| D1867 | S1867 | 885 | GfaAfucfaAfaGfAfaAfUfUfcUfaGfaAfaAfgfL96 | AS1867 | 1977 | uUfuCfuagAfaUfuccUfuUfgAfuUfcsUfsu | | | | |
| D1868 | S1868 | 886 | AfaUfcfaAfaGfAfaAfuUfcUfAfaAfaGfaAfgfuAfL96 | AS1868 | 1978 | cUfuUfcUfAfGfaAfuucCfuUfuGfaUfusCfsu | | | | |
| D1869 | S1869 | 887 | AfaUfcAfaAfgGfaAfUfUfcUfAfgAfaGfaAfuAfL96 | AS1869 | 1979 | cUfuUfcuaGfaAfuucCfuUfgAfuUfasCfsu | | | | |
| D1870 | S1870 | 888 | AfuCfaAfaGfgAfAfUfucfuaGfaAfaAfgUfL96 | AS1870 | 1980 | aCfuUfucUfuFfAfgAfauuCfcUfuUfgAfusUfsc | | | | |
| D1871 | S1871 | 889 | AfutCfaAfaGfgAfAfUfucUfaGfaAfaAfgAfaGfuUfL96 | AS1871 | 1981 | aCfuUfucuAfgAfauuCfcUfuUfgAfusUfsc | | | | |
| D1872 | S1872 | 890 | UfcCfaAfaGfgAfAfUfUfcUfaGfaAfaGfuAfL96 | AS1872 | 1982 | uAfcUfuUfcUfAfgaauUfcCfuUfuGfasUfsu | | | | |
| D1873 | S1873 | 891 | UfcCfaAfaGfaAfUfUfcfuAfgaaAfgUfaAfL96 | AS1873 | 1983 | uAfcUfuucGfaaUfcCfuUfuGfasUfsu | | | | |
| D1874 | S1874 | 892 | CfaAfaGfgAfAfUfcfuAfgaaaAfgUfaAfL96 | AS1874 | 1984 | aUfaCfuUfUfcUfAfgaaUfcCfuUfuGfasAfsu | | | | |
| D1875 | S1875 | 893 | CfaAfaGfgAfAfufUfcfuAfgAfaAfgUfaAfUfL96 | AS1875 | 1985 | aUfaCfuuucGfuAfgaaUfcUfcUfuUfgsAfsu | | | | |
| D1876 | S1876 | 894 | AfaAfgGfaAfufUfcfuAfgAfaaGfaAfuAfucfL96 | AS1876 | 1986 | gAfuAfcUfUfUfcUfagaAfuUfcCfuUfusGfsa | | | | |

TABLE 1-continued

RNAi Agents and Results of In Vitro Screening

| Duplex ID | s ID | SEQ ID NO: | Sense strand (S) | AS ID | SEQ ID NO: | Antisense strand (AS) | % of mRNA remained conc. of siRNA 1 nM | 0.1 nM | 0.01 nM | IC50 (nM) |
|---|---|---|---|---|---|---|---|---|---|---|
| D1877 | S1877 | 895 | AfaAfgGfaAfuUfcFfUfaGfaAfAfgUfaAfuCfL96 | AS1877 | 1987 | gAfuAfcuuUfcUfagaAfuUfcCfuUfusGfsa | | | | |
| D1878 | S1878 | 896 | AfaGfgAfaUfucUfUfAfgAfaagUfaUfcUfL96 | AS1878 | 1988 | aGfaUfacUfUfUfuCfuagAfaUfuCfcUfusUfsg | | | | |
| D1879 | S1879 | 897 | AfaGfgAfaUfucUfUfAfgAfaAfgUfaAfuCfUfL96 | AS1879 | 1989 | aGfaUfacuUfuCfuagAfaUfuCfcUfusUfsg | | | | |
| D1880 | S1880 | 898 | AfgGfaAfuUfcUfUfAfgFfaAfagUfaAfuCfuGfL96 | AS1880 | 1990 | cAfgAfuAfcUfUfuCfuagAfaUfuCfcCfusUfsu | | | | |
| D1881 | S1881 | 899 | AfGfaAfuUfcUfUfAfGfaAfAfgUfaAfuCfuGfL96 | AS1881 | 1991 | cAfgAfuacUfUfuCfuaGfaAfuUfccCfusUfsu | | | | |
| D1882 | S1882 | 900 | GfGfaUfucUfuAfGfAfaAfAfguaUfcUfgGfL96 | AS1882 | 1992 | cCfaGfaUfAfCfuUfucuAfgAfaUfuCfcsUfsu | | | | |
| D1883 | S1883 | 901 | GfGfaUfucUfuAfGfAfaAfAfgUfAfUfUfcUfgGfL96 | AS1883 | 1993 | cCfaGfauaCfuUfucuAfgAfaUfuCfcsUfsu | | | | |
| D1884 | S1884 | 902 | GfaAfuUfcUfaGfAfAfAfAfgUfaUfcUfgGfgFL96 | AS1884 | 1994 | cCfcAfgAfUfAfcUfuucUfaGfaAfuUfcsCfsu | | | | |
| D1885 | S1885 | 903 | GfaAfuUfcUfaGfAfAfAfAfgUfAfgUfgCfL96 | AS1885 | 1995 | cCfcAfgauAfcUfuucUfaGfaAfuUfcsCfsu | | | | |
| D1886 | S1886 | 904 | AfaUfuCfuAfgAfAfAfAfgUfaucUfaGfGfCfL96 | AS1886 | 1996 | gCfcCfagAfAfCfuuuCfuAfgAfaUfusCfsc | | | | |
| D1887 | S1887 | 905 | AfaUfuCfuAfgAfAfAfgUfaUfcUfugGfgCfL96 | AS1887 | 1997 | gCfcCfagaCfAfuuuCfuAfgAfaUfusCfsc | | | | |
| D1888 | S1888 | 906 | AfuUfcUfaGfaAfAfgUfuAfucuGfGfcAfL96 | AS1888 | 1998 | uGfcCfcAfgFfAfuAfcuuUfcUfaGfaAfusUfsc | | | | |
| D1889 | S1889 | 907 | AfuUfcUfaGfaAfAfAfgUfuAfuCfUfgGfgCfL96 | AS1889 | 1999 | uGfcCfcagAfuAfcuUfcUfaGfaAfusUfsc | | | | |
| D1890 | S1890 | 908 | UfuCfuAfgAfaAfAfgUfUfuAfuCfugGfCfAfgFL96 | AS1890 | 2000 | cUfgCfcCfAfGfaUfacUfuCfuAfgAfAfsUfsu | | | | |
| D1891 | S1891 | 909 | UfuCfuAfgAfaAfAfgUfuAfuCfUfgggCfCAfgFL96 | AS1891 | 2001 | cUfgCfccaGfaUfacUfuCfuAfgAfaAfsUfsu | | | | |
| D1892 | S1892 | 910 | UfcUfaGfaAfaAfgUfuFfAfuCfuggGfCfAfgAfL96 | AS1892 | 2002 | uCfuGfcCfAfgAfuacUfuCfuAfgAfasAfsu | | | | |
| D1893 | S1893 | 911 | UfcUfaGfaAfaAfgUfuAfucUfgGfgCfCfAfgAfL96 | AS1893 | 2003 | uCfuGfcccAfgAfuacUfuCfuAfgAfasAfsu | | | | |
| D1894 | S1894 | 912 | CfuAfgAfaAfaGfuAfUfcUfggCfaGfaAfL96 | AS1894 | 2004 | uUfcUfgCfCfCfaGfauaCfuUfuCfuAfgsAfsa | | | | |
| D1895 | S1895 | 913 | CfuAfgAfaAfagUfAfUfcUfgGfcCfaGfaAfL96 | AS1895 | 2005 | uUfcUfgccCfaGfauaCfuUfuCfuAfgsAfsa | | | | |
| D1896 | S1896 | 914 | UfaGfaAfagUfaUfCfUfCfuGfgcCfaGfaAfCfL96 | AS1896 | 2006 | gUfuCfuGfCfCfAfgauAfcUfuUfcUfasGfsa | | | | |
| D1897 | S1897 | 915 | UfaGfaAfagUfaUfCfuGfgGfCfAfgAfaCfL96 | AS1897 | 2007 | gUfuCfugcCfCfAfgauAfcUfuUfcUfasGfsa | | | | |
| D1898 | S1898 | 916 | AfgGfaAfaUfgUfAfUfgGfgcagGfaAfcGfL96 | AS1898 | 2008 | cGfeUfcCfUfgCfccCfagauUfacCfuUfuCfusAfsg | | | | |

TABLE 1-continued

RNAi Agents and Results of In Vitro Screening

| Duplex ID | S ID | SEQ ID NO: | Sense strand (S) | AS ID | SEQ ID NO: | Antisense strand (AS) | % of mRNA remained conc. of siRNA 1 nM | 0.1 nM | 0.01 nM | IC50 (nM) |
|---|---|---|---|---|---|---|---|---|---|---|
| D1899 | S1899 | 917 | AfgAfaAfgUfaUfCfUfggGfgCfAfGfaAfcGfL96 | AS1899 | 2009 | cGfuUfcugCfcCfagaUfaCfuUfcfucfusAfsg | | | | |
| D1900 | S1900 | 918 | GfaAfaGfuAfuCfUfgGfgCfcagAfaCfgCfL96 | AS1900 | 2010 | gCfgUfuCfUfGfcCfcagAfuAfcUfuUfcsUfsa | | | | |
| D1901 | S1901 | 919 | GfaAfaGfuAfuCfUfgGfgCfcAfAfaCfUfcsUfgs | AS1901 | 2011 | gCfgUfucuGfcCfcagAfuAfcUfuUfcsUfsa | | | | |
| D1902 | S1902 | 920 | AfaAfgUfaUfcUfUfgGfgCfCfagaAfcGfcUfL96 | AS1902 | 2012 | aGfcGfuUfCfUfgCfccaGfaUfaCfuUfuscCfsu | | | | |
| D1903 | S1903 | 921 | AfaAfgUfaUfcUfUfgGfgCfCfagAfAfaCfgCfcUfL96 | AS1903 | 2013 | aGfcGfuucUfgCfccaGfaUfaCfuUfuscCfsu | | | | |
| D1904 | S1904 | 922 | AfaGfuAfuCfuGfgGfgCfgCfAfgaaCfgCfCfuAfL96 | AS1904 | 2014 | uAfgCfgUfCfuGfcccAfgAfuAfcUfusUfsc | | | | |
| D1905 | S1905 | 923 | AfaGfuAfuCfuGfgCfgCfgCfcAfgaAfcCfgCfuAfL96 | AS1905 | 2015 | uAfgCfguuCfuGfcccAfgAfuAfcUfusUfsc | | | | |
| D1906 | S1906 | 924 | AfgUfaUfcUfgGfgCfgCfcAfgAfaCfgCfuAfgGfL96 | AS1906 | 2016 | cUfaGfcGfUfUfcUfgccCfaGfaUfaCfusUfsu | | | | |
| D1907 | S1907 | 925 | AfgUfaUfcUfgGfgCfgCfcAfgAfaCfgCfuAfgGfL96 | AS1907 | 2017 | cUfaGfcguUfcUfgccCfaGfaUfaCfusUfsu | | | | |
| D1908 | S1908 | 926 | GfuAfuCfuGfgGfgCfgCfCfAfgAfaCfgCfuAfgGfL96 | AS1908 | 2018 | cCfuAfgCfGfUfufgcCfCfAfgAfuAfcsUfsu | | | | |
| D1909 | S1909 | 927 | GfuAfuCfuGfgGfgCfgCfCfAfgAfaCfgCfuAfgGfL96 | AS1909 | 2019 | cCfuAfgcgUfucUfgcCfcAfgAfuAfcsUfsu | | | | |
| D1910 | S1910 | 928 | UfaUfcUfgGfgCfgCfAfGfAfaCfgcUfaGfgAfL96 | AS1910 | 2020 | uCfcUfaGfcGfuUfcugCfcCfaGfaUfasCfsu | | | | |
| D1911 | S1911 | 929 | UfaUfcUfgGfgCfAfGfAfaCfgcuAfgGfaGfL96 | AS1911 | 2021 | uCfcUfagcGfuUfcugCfcCfaGfaUfasCfsu | | | | |
| D1912 | S1912 | 930 | AfuCfuGfgGfcAfgAfAfaCfgCfuAfgGfAfsc | AS1912 | 2022 | cUfcCfuAfGfCfgUfucuGfcCfcAfgAfusAfsc | | | | |
| D1913 | S1913 | 931 | AfuCfuGfgGfcAfgAfAfaCfgCfuAfgGfAfsc | AS1913 | 2023 | cUfcCfuagCfgUfucuGfcCfcAfgAfusAfsc | | | | |
| D1914 | S1914 | 932 | UfcCfuGfgGfcfagAfAfcfcuaGfgAfL96 | AS1914 | 2024 | uCfuCfcUfAfGfcGfuucUfgCfcCfaGfasUfsa | | | | |
| D1915 | S1915 | 933 | UfcUfgGfgCfagAfAfcfGfcUfAfgGfAfgAfL96 | AS1915 | 2025 | uCfuCfcuaGfcGfuucUfgCfcCfaGfasUfsa | | | | |
| D1916 | S1916 | 934 | CfuGfgGfcAfgAfAfCfgCfuAfgGfaGfL96 | AS1916 | 2026 | cUfuCfcUfAfGfCfgUfuuCfgCfcCfAfgsAfsu | | | | |
| D1917 | S1917 | 935 | CfuGfgGfcAfgAfAfCfgCfuAfgGfaGfL96 | AS1917 | 2027 | cUfuCfccuAfgCfguuCfgCfcCfAfgsAfsu | | | | |
| D1918 | S1918 | 936 | UfgGfgCfAfgAfAfcCfgCfuAfaggAfgAfgAfL96 | AS1918 | 2028 | uCfuCfucUfCfCfuAfGfguUfcUfgCfcCfasGfsa | | | | |
| D1919 | S1919 | 937 | UfgGfgCfAfgAfAfCfgCfuAfgAfgAfL96 | AS1919 | 2029 | uCfuCfuccUfAfgcguUfcUfgCfcCfasGfsa | | | | |
| D1920 | S1920 | 938 | GfgGfcAfgAfAfcCfgCfuAfggAfGfaGfaUfL96 | AS1920 | 2030 | aUfcUfcUfCfCfuAfgcgUfuCfuAfgcgCfcAfsg | | | | |
| D1921 | S1921 | 939 | GfgGfcAfgAfAfcCfgCfuAfgGfaGfaGfuUfL96 | AS1921 | 2031 | aUfcUfcucCfuAfgcgUfuCfuGfcCfcsAfsg | | | | |

TABLE 1-continued

RNAi Agents and Results of In Vitro Screening

| Duplex ID | SEQ ID NO: | s ID | Sense strand (S) | SEQ ID NO: | AS ID | Antisense strand (AS) | % of mRNA remained conc. of siRNA | | | IC50 (nM) |
|---|---|---|---|---|---|---|---|---|---|---|
| | | | | | | | 1 nM | 0.1 nM | 0.01 nM | |
| D1922 | 940 | S1922 | GfgCfaGfaAfcGfcGfCfUfaGfgagAfgaAfgAfucUfL96 | 2032 | AS1922 | gAfuCfucCfUfCfcUfagcGfuUfcUfgCfcsCfsa | | | | |
| D1923 | 941 | S1923 | GfgCfaGfaAfcGfcGfCfUfaGfgagAfGfgAfgAfucUfL96 | 2033 | AS1923 | gAfuCfucuCfcUfagcGfuUfcUfgCfcsCfsa | | | | |
| D1924 | 942 | S1924 | GfcAfgGfaAfcGfcGfCfUfAfgGfgagaGfaUfcCfL96 | 2034 | AS1924 | gGfaUfcUfCfUfcCfuagCfgUfcUfgCfcsCfsc | | | | |
| D1925 | 943 | S1925 | GfcAfgGfaAfcGfcGfCfUfAfgGfgaGfaGfgAfucUfL96 | 2035 | AS1925 | gGfaUfcucUfCfuagCfgUfcUfgCfcsCfsc | | | | |
| D1926 | 944 | S1926 | CfaGfaAfcGfcGfcUfAfgGfgGfgagAfguCfcAfucUfL96 | 2036 | AS1926 | uGfgAfucCfUfCfuCfuaGfcGfuUfcUfgsCfsc | | | | |
| D1927 | 945 | S1927 | CfaGfaAfcGfcGfcUfAfgGfgGfgagAfgAfgCfucAfL96 | 2037 | AS1927 | uGfgAfucuCfUfcfcuaGfcGfuUfcUfgsCfsc | | | | |
| D1928 | 946 | S1928 | AfgAfaCfgCfuAfgGfGfaGfagaUfcCfaAfL96 | 2038 | AS1928 | uUfgGfaUfCfUfcCfcuAfgCfgUfcUfusGfsc | | | | |
| D1929 | 947 | S1929 | AfgAfaCfgCfuAfgGfGfaGfAfgfAfgfAfcCfaAfL96 | 2039 | AS1929 | uUfgGfaucUfcUfcuAfgCfgUfcUfusGfsc | | | | |
| D1930 | 948 | S1930 | GfaAfcGfcUfaGfgGfAfAfgAfgauCfcAfaAfL96 | 2040 | AS1930 | uUfuGfgAfuCfuCfuAfgCfgUfuUfcsUfsg | | | | |
| D1931 | 949 | S1931 | GfaAfcGfcUfaGfgGfAfGfgauCfcAfaAfUfL96 | 2041 | AS1931 | uUfuGfgauCfuCfuccUfaGfcGfuUfcsUfsg | | | | |
| D1932 | 950 | S1932 | AfaCfgCfuAfgGfaGfGfaGfagUfcCfaAfaAfL96 | 2042 | AS1932 | aUfuUfgGfAfUfCfuccCfuAfgCfgUfuUfusCfsu | | | | |
| D1933 | 951 | S1933 | AfaCfgCfuAfgGfGfAfGfagUfcCfaAfaAfuL96 | 2043 | AS1933 | aUfuUfggaUfcUfuccCfuAfgCfgUfusCfsu | | | | |
| D1934 | 952 | S1934 | AfcGfcUfaGfgGfaGfgAfgAfgUfccAfaAfuCfL96 | 2044 | AS1934 | aAfuUfuGfGfAfUfcucCfuAfgCfgUfusUfsc | | | | |
| D1935 | 953 | S1935 | AfcGfcUfaGfgGfaGfAfgAfgfAfgUfuUfL96 | 2045 | AS1935 | aAfuUfuggAfuCfucCfuAfgCfgUfusUfsu | | | | |
| D1936 | 954 | S1936 | CfgcCfuAfgGfaGfGfAfgAfguCfcAfaAfuUfcCfL96 | 2046 | AS1936 | aAfaUfuUfGfGfAfucUfcCfuAfgCfgUfsUfsu | | | | |
| D1937 | 955 | S1937 | CfgCfuAfgGfaGfGfAfAfgfAfucCfaaAfuUfcCfL96 | 2047 | AS1937 | aAfaUfuuggAfuUfUfgfgAfuCfuAfgCfgsUfsu | | | | |
| D1938 | 956 | S1938 | GfcUfaGfgGfaGfAfgAfgfAfgUfccAfaAfuUfcCfL96 | 2048 | AS1938 | gAfaAfuUfUfgGfaucUfcUfcAfgCfcsGfsu | | | | |
| D1939 | 957 | S1939 | GfcUfAfgGfgAfGfAfgAfgucCfaAfAfuUfuCfL96 | 2049 | AS1939 | gAfaAfuuuGfAfucucUfcUfaGfCfsGfsu | | | | |
| D1940 | 958 | S1940 | CfuAfgGfgAfgAfgAfGfUfcCfaaaAfuUfuCfCfL96 | 2050 | AS1940 | gGfaaAfaUfUfUfgGfaucUfcUfcCfuAfgsCfsg | | | | |
| D1941 | 959 | S1941 | CfuAfgGfgAfgAfgAfGfUfcCfaaaAfuUfuCfCfL96 | 2051 | AS1941 | gAfaAfauUfUfgGfaucUfcUfcCfuAfgsCfsg | | | | |
| D1942 | 960 | S1942 | UfaGfgGfaGfaGfAfUfCfCfaAfaAfUfuUfcCfaAfL96 | 2052 | AS1942 | uGfGfaAfaUfUfuGfgaucUfcUfcCfuAfgsCfsc | | | | |
| D1943 | 961 | S1943 | UfaGfgGfaGfaGfAfUfCfCfaAfaAfUfuUfcCfaAfL96 | 2053 | AS1943 | uGfGfaAfaauUfUfgauCfuCfuCfcUfasGfsc | | | | |

TABLE 1-continued

RNAi Agents and Results of In Vitro Screening

| Duplex ID | S ID | SEQ ID NO: | Sense strand (S) | AS ID | SEQ ID NO: | Antisense strand (AS) | % of mRNA remained conc. of siRNA 1 nM | 0.1 nM | 0.01 nM | IC50 (nM) |
|---|---|---|---|---|---|---|---|---|---|---|
| D1944 | S1944 | 962 | AfgGfaGfaGfaGfcUfCfcAfaUfccCfaUfL96 | AS1944 | 2054 | aUfgGfaAfAfUfggaUfgUfcUfcCfusAfsg | | | | |
| D1945 | S1945 | 963 | AfgGfaGfaGfaGfcUfCfcAfaAfauuUfcCfaUfL96 | AS1945 | 2055 | aUfgGfaaaUfuUfggaUfcUfcUfcCfusAfsg | | | | |
| D1946 | S1946 | 964 | GfgAfgAfgAfuCfCfcAfaAfauuUfcCfaAfuUfL96 | AS1946 | 2056 | aAfuGfgAfAfAfuUfuggAfuCfuCfcUfcsUfsa | | | | |
| D1947 | S1947 | 965 | GfgAfgAfgAfuCfCfcAfaAfauUfuCfCfaAfuUfL96 | AS1947 | 2057 | aAfuGfgaaAfuUfuggAfuCfuCfuCfcsUfsa | | | | |
| D1948 | S1948 | 966 | GfaGfaGfaGfaUfCfcAfaAfaUfuuuCfaAfuGfL96 | AS1948 | 2058 | cAfaUfgGfAfAfAfuUfuggGfaUfcUfcUfcsCfsu | | | | |
| D1949 | S1949 | 967 | GfaGfaGfaGfaUfCfcAfaAfaUfuCfcfaUfuGfL96 | AS1949 | 2059 | cAfaUfggaAfaUfuugGfaUfcUfcUfcsCfsu | | | | |
| D1950 | S1950 | 968 | AfgAfgAfgAfuCfcAfAfAfaUfuuccAfuUfgUfL96 | AS1950 | 2060 | aCfaAfuGfGfAfAfAfuuuGfgAfuCfuCfusCfsc | | | | |
| D1951 | S1951 | 969 | AfgAfgAfgAfuCfcAfAfAfaUfuUfccAfuUfgUfL96 | AS1951 | 2061 | aCfaAfuggAfaAfuAfuuuGfaAfuCfuCfusCfsc | | | | |
| D1952 | S1952 | 970 | GfaGfaUfCfcAfaAfaUfuUfuCfccaUfugUfCfL96 | AS1952 | 2062 | gAfcAfAfuGfGfaAfauUfuUfgGfaUfCfUfcsUfsc | | | | |
| D1953 | S1953 | 971 | GfaGfaUfCfcAfaAfaUfuUfuCfCfaUfugUfCfL96 | AS1953 | 2063 | gAfcAfAfuggAfaAfauUfuUfgGfaUfUfcsUfsc | | | | |
| D1954 | S1954 | 972 | AfgAfuCfCfaAfaAfuUfuCfcauUfgUfcUfL96 | AS1954 | 2064 | aGfaCfaAfUfGfgAfaauUfuGfgAfuCfusCfsu | | | | |
| D1955 | S1955 | 973 | AfgAfuCfCfaAfaAfuUfuCfCfaUfuGfuCfUfL96 | AS1955 | 2065 | aGfaCfaauGfGfaAfauUfuGfgAfuCfusCfsu | | | | |
| D1956 | S1956 | 974 | GfaUfCfCfaAfaAfuUfuCfCfauuGfuCfUfUfL96 | AS1956 | 2066 | aAfgAfcAfAfUfggGfaaaUfuUfgGfaUfcsUfsc | | | | |
| D1957 | S1957 | 975 | GfaUfCfCfaAfaAfuUfuCfCfaUfuGfuCfuUfL96 | AS1957 | 2067 | aAfgAfcaaUfgGfaaaUfuUfgGfaUfcsUfsc | | | | |
| D1958 | S1958 | 976 | AfuCfcAfaAfaUfuUfCfCfaUfuGfucUfuGfL96 | AS1958 | 2068 | cAfaGfaCfAfAfUfgGfaaAfuUfuGfgAfusCfsu | | | | |
| D1959 | S1959 | 977 | AfuCfcAfaAfaUfuUfCfCfaUfuGfuCfuUfgfL96 | AS1959 | 2069 | cAfaGfacaAfuGfaaAfuUfuGfgAfusCfsu | | | | |
| D1960 | S1960 | 978 | UfcCfaAfaUfuUfCfCfaUfugucUfuGfCfL96 | AS1960 | 2070 | gCfaAfgAfCfAfuGfgaAfaUfuUfgGfasUfsc | | | | |
| D1961 | S1961 | 979 | UfcCfaAfaUfuUfCfCfaUfuGfCfuUfgCfL96 | AS1961 | 2071 | gCfaAfgacAfaUfggaAfaUfuUfgGfasUfsc | | | | |
| D1962 | S1962 | 980 | CfCfaAfaAfuUfuCfCfaUfuGfucUfuGfcAfL96 | AS1962 | 2072 | uGfCfaAfgAfCfAfuggAfaAfuUfuGfgsAfsu | | | | |
| D1963 | S1963 | 981 | CfCfaAfaAfuUfuCfCfaUfuGfucUfuGfcAfL96 | AS1963 | 2073 | uGfCfaAfgaCfAfuggAfaAfuUfuGfgsAfsu | | | | |
| D1964 | S1964 | 982 | CfaAfaUfuUfcCfaUfUfuGfucuUfgCfaAfL96 | AS1964 | 2074 | uUfgCfaAfgGfAfcAfugGfaAfAfuUfugsGfsa | | | | |
| D1965 | S1965 | 983 | CfaAfaUfuUfcCfaUfuGfuCfuUfgCfaAfL96 | AS1965 | 2075 | uUfgCfaagAfcAfaugAfcAfaUfuUfgsCfsa | | | | |
| D1966 | S1966 | 984 | AfaAfuUfuCfcAfUfUfgUfcuuGfcAfaGfL96 | AS1966 | 2076 | cUfuGfcAfAfGfaCfaauGfgAfAfuUfusCfsg | | | | |

TABLE 1-continued

RNAi Agents and Results of In Vitro Screening

| Duplex ID | S ID | SEQ ID NO: | Sense strand (S) | AS ID | SEQ ID NO: | Antisense strand (AS) | % of mRNA remained conc. of siRNA 1 nM | 0.1 nM | 0.01 nM | IC50 (nM) |
|---|---|---|---|---|---|---|---|---|---|---|
| D1967 | S1967 | 985 | AfaAfuUfcCfcAfUfUfgUfcUfUfgCfAfaGfL96 | AS1967 | 2077 | cUfuGfcaaGfacCfaauGfgAfaAfuUfusGfsg | | | | |
| D1968 | S1968 | 986 | AfaUfuUfcCfaUfUfgUfcUfuugCfaAfgCfL96 | AS1968 | 2078 | gCfuUfgCfAfAfgAfcaaUfgGfaAfaUfusUfsg | | | | |
| D1969 | S1969 | 987 | AfaUfuUfcCfaUfUfgUfcUfuUfgCfAfaGfcfL96 | AS1969 | 2079 | gCfuUfgcaAfgAfcaaUfgGfaAfaUfusUfsg | | | | |
| D1970 | S1970 | 988 | AfuUfuCfcAfuUfUfgUfcUfuugCfaAfgCfAfL96 | AS1970 | 2080 | uGfcUfugGfcfaAfgAfacaAfuGfgAfaAfusUfsu | | | | |
| D1971 | S1971 | 989 | AfuUfuCfcAfuUfgUfcUfuUfgCfCfuAfaGfcfL96 | AS1971 | 2081 | uGfcCfugcAfaGfacaAfuGfgAfaAfusUfsu | | | | |
| D1972 | S1972 | 990 | UfuUfcCfaUfUfgUfCfCfuUfgCfaAfgCfAfL96 | AS1972 | 2082 | uUfgCfuUfgCfaAfgacAfaUfgGfaAfasUfsu | | | | |
| D1973 | S1973 | 991 | UfuUfcCfaUfUfgUfcUfuUfgCfaAfgCfAfAfL96 | AS1973 | 2083 | uUfgCfuugCfaAfgacAfaUfgGfaAfasUfsu | | | | |
| D1974 | S1974 | 992 | UfuUfcCfaUfUfgUfcUfuUfgCfaaGfcAfaAfL96 | AS1974 | 2084 | uUfuGfcUfUfgCfAfagaCfaAfuGfgAfasAfsu | | | | |
| D1975 | S1975 | 993 | UfuUfcCfaAfuUfgUfcUfuUfgCfaAfgCfAfAfL96 | AS1975 | 2085 | uUfuGfcuuGfcAfagaCfaAfuGfgAfasAfsu | | | | |
| D1976 | S1976 | 994 | UfcCfaUfuGfuCfuUfUfgCfaagCfaAfaGfL96 | AS1976 | 2086 | cUfuUfgCfUfUfgCfaagAfcAfaUfgGfasAfsa | | | | |
| D1977 | S1977 | 995 | UfcCfaUfuGfuCfuUfUfgCfaAfgCfAfaGfL96 | AS1977 | 2087 | cUfuUfgCfcuUfgCfaagAfcAfaUfgGfasAfsa | | | | |
| D1978 | S1978 | 996 | CfcAfuUfgUfcUfUfgCfAfafgcAfaAfgCfL96 | AS1978 | 2088 | gCfuUfuGfcUfUfgCfaaGfaCfaAfuGfgAfsAfsa | | | | |
| D1979 | S1979 | 997 | CfcAfuUfgUfcUfuUfgCfcAfafgcaAfgCfL96 | AS1979 | 2089 | gCfuUfgCfuugCfUfUfgCfaaGfacAfaUfgsGfsa | | | | |
| D1980 | S1980 | 998 | CfaUfuGfucUfUfUfgCfCfaAfgCfaAfgCfL96 | AS1980 | 2090 | uGfcUfUfgCfUfUfgCfcaAfgAfcAfaUfgsGfsa | | | | |
| D1981 | S1981 | 999 | CfaUfuGfuCfuUfUfgCfCfaAfgCfAfAfgCfL96 | AS1981 | 2091 | uGfcUfUfuugCfUfUfgCfaAfgAfcAfaUfgsGfsa | | | | |
| D1982 | S1982 | 1000 | AfuUfgUfcUfuUfgCfCfaAfgCfaAfgCfaCfL96 | AS1982 | 2092 | gUfgCfuUfUfgCfuUfgcAfgAfcAfaUfusGfsg | | | | |
| D1983 | S1983 | 1001 | AfuUfgUfcUfuUfgCfCfaAfgCfAfAfgCfaCfL96 | AS1983 | 2093 | gUfgCfuuuGfcUfUfgcAfaGfaCfaAfusGfsg | | | | |
| D1984 | S1984 | 1002 | UfuGfcUfUfUfgCfCfaAfgCfaAfaGfcAfcGfL96 | AS1984 | 2094 | cGfuGfcUfUfUfgCfuugCfaAfgAfcAfasUfsg | | | | |
| D1985 | S1985 | 1003 | UfuGfcUfuUfgCfCfaAfgCfaAfgCfaCfgGfL96 | AS1985 | 2095 | cGfuGfcuuUfgCfuugCfaAfgCfaAfgAfcAfsUfsg | | | | |
| D1986 | S1986 | 1004 | UfgUfcUfuUfgCfCfaAfgCfaAfgCfaCfgUfL96 | AS1986 | 2096 | aCfgUfgCfuUfUfgGfcuuGfcAfaGfcAfasAfsu | | | | |
| D1987 | S1987 | 1005 | UfgUfcUfuUfgCfCfaAfgCfaAfgCfaCfgUfL96 | AS1987 | 2097 | aCfgUfgCfuUfuGfcuuGfcAfaGfaCfaAfsAfsu | | | | |
| D1988 | S1988 | 1006 | GfuCfuUfgCfaAfgCfaAfgCfaCfgUfaAfL96 | AS1988 | 2098 | uAfcGfuGfcUfUfUfgCfuUfgcuUfgCfaAfgCfsAfsa | | | | |

TABLE 1-continued

RNAi Agents and Results of In Vitro Screening

| Duplex ID | SEQ ID NO: Sense strand (S) | | SEQ ID NO: Antisense strand (AS) | | % of mRNA remained conc. of siRNA | | | IC50 (nM) |
|---|---|---|---|---|---|---|---|---|
| | s ID | | AS ID | | 1 nM | 0.1 nM | 0.01 nM | |
| D1989 | S1989 | 1007 GfuCfuUfgCfcAfaAfgCfcAfaAfaGfcCfAfcGfuAfL96 | AS1989 | 2099 uAfcGfugcUfuUfgcuUfgCfaAfgAfcsAfsa | | | | |
| D1990 | S1990 | 1008 UfcUfUfgCfaAfgCfcAfaAfgcaCfgUfaUfL96 | AS1990 | 2100 aUfaCfgUfgCfcUfuUfgcUfuUfgcUfcAfaGfasCfsa | | | | |
| D1991 | S1991 | 1009 UfcUfuGfcAfaAfgCfcAfaAfgCfcAfaAfaGfcCfAfcGfuAfL96 | AS1991 | 2101 aUfaCfgUfgCfuUfgcUfuUfgcUfcAfaGfasCfsa | | | | |
| D1992 | S1992 | 1010 CfuUfgCfaAfgCfcAfaAfgcCfacGfuAfiUfL96 | AS1992 | 2102 aAfuAfcGfUfgCfUfuugCfuUfgCfaAfgsAfsc | | | | |
| D1993 | S1993 | 1011 CfuUfgCfaAfgCfcAfaAfgCfcAfcGfuAfuUfL96 | AS1993 | 2103 aAfuAfcguGfcUfuugCfUfgCfaAfgsAfsc | | | | |
| D1994 | S1994 | 1012 UfuUfgCfaAfgCfcAfaAfaAfgCfacgUfaUfuAfL96 | AS1994 | 2104 uAfaUfaCfgUfgCfuuuGfcUfuGfcAfasGfsa | | | | |
| D1995 | S1995 | 1013 UfuGfcAfaAfgCfcAfaCfgCfuUfuUfaAfL96 | AS1995 | 2105 uAfaUfacgUfgCfuuuGfcUfuGfcAfasGfsa | | | | |
| D1996 | S1996 | 1014 UfgCfaAfgCfcAfaAfgCfcAfcgUfaUfuAfaAfL96 | AS1996 | 2106 uUfaAfuAfCfgUfcuuUfgCfuUfgCfasAfsg | | | | |
| D1997 | S1997 | 1015 UfgCfaAfgCfcAfaAfgCfcAfcCfgUfaUfaAfuUfL96 | AS1997 | 2107 uUfaAfuacGfuGfcuuUfgCfuUfgCfasAfsg | | | | |
| D1998 | S1998 | 1016 GfcAfaAfgCfcAfaAfgCfcAfcCfguaAfiuAfaAfL96 | AS1998 | 2108 uUfuAfaUfAfCfgUfcuUfuGfcUfuGfcAfsa | | | | |
| D1999 | S1999 | 1017 GfcAfaGfcAfaAfgCfcAfcCfgUfuaUfaAfaAfL96 | AS1999 | 2109 uUfuAfauaCfgUfgcuUfuGfcUfuGfcAfsa | | | | |
| D2000 | S2000 | 1018 CfaaAfgCfaAfaGfcCfAfcGfuAfUfgUfauUfaAfaAfL96 | AS2000 | 2110 aUfUfUfaAfcGfugcUfuUfgCfuUfgsCfsa | | | | |
| D2001 | S2001 | 1019 CfaAfgCfaAfaAfgCfCfaCfgUfauuAfaAfuAfL96 | AS2001 | 2111 aUfUfUfaauAfcGfugcUfuUfgCfuUfgsCfsa | | | | |
| D2002 | S2002 | 1020 AfaGfcCfaAfaAfgCfCfaCfgUfauuAfaAfuAfL96 | AS2002 | 2112 uAfuUfUfaAfAfUfaCfguugCfuUfuGfcUfusGfsc | | | | |
| D2003 | S2003 | 1021 AfaGfcAfaAfgCfcAfCfgUfaUfAfuAfAfuGfL96 | AS2003 | 2113 uAfuUfuaaAfuAfacfgugCfuUfuGfcUfusGfsc | | | | |
| D2004 | S2004 | 1022 AfgCfaAfaGfcCfAfcGfUfAfUfaAfuUfgAfL96 | AS2004 | 2114 aUfaUfUfuaAfAfuAfcguCfuUfuGfcCfusUfsg | | | | |
| D2005 | S2005 | 1023 AfgCfaAfaGfcCfAfcGfUfaUfuAfuUfaAfaUfgAfL96 | AS2005 | 2115 aUfaUfuuaAfuAfuAfcgUfcUfuUfgCfusUfsg | | | | |
| D2006 | S2006 | 1024 GfcAfaAfgCfcAfCfgUfaUfuAfaAfaUfAfuGfL96 | AS2006 | 2116 cAfuAfuUfuUfaAfuAfacgUfgCfuUfuGfcsUfsu | | | | |
| D2007 | S2007 | 1025 GfcAfaAfgCfcAfcCfgUfaUfuAfuUfuAfAfaUfuGfL96 | AS2007 | 2117 cAfuAfuuuAfuAfacgUfgCfuUfuGfcsUfsu | | | | |
| D2008 | S2008 | 1026 CfaAfaGfcCfaCfcfGfuUfaUfaaAfuUfuGfcL96 | AS2008 | 2118 ucCfaAfuUfuAfuaGfuCfuUfuGfcsCfsu | | | | |
| D2009 | S2009 | 1027 CfaAfaGfcCfAfcGfUfaUfuAfuUfaAfuAfuGfL96 | AS2009 | 2119 uCfaUfauuUfaAfuacGfuGfcUfuUfgsCfsu | | | | |
| D2010 | S2010 | 1028 AfaAfgCfcAfcCfgUfAfUfUfaAfuAfuGfuUfL96 | AS2010 | 2120 aUfaCfAfuAfUfUfaAfauaCfgUfgCfuUfusGfsc | | | | |
| D2011 | S2011 | 1029 AfaAfgCfcAfcCfgUfAfUfUfaAfAfAfugfAfL96 | AS2011 | 2121 aUfcAfuauUfaFfauaCfgUfgCfuUfusGfsc | | | | |

TABLE 1-continued

RNAi Agents and Results of In Vitro Screening

| Duplex ID | s ID | SEQ ID NO: Sense strand (S) | AS ID | SEQ ID NO: Antisense strand (AS) | % of mRNA remained conc. of siRNA 1 nM | 0.1 nM | 0.01 nM | IC50 (nM) |
|---|---|---|---|---|---|---|---|---|
| D2012 | S2012 | 1030 AfaGfcAfcGfuaCfuaAfauaUfgaAfucUfL96 | AS2012 | 2122 gAfuCfaUfAfUfuUfaauAfcGfuGfcUfusUfsg | | | | |
| D2013 | S2013 | 1031 AfaGfcAfcGfuaUfUfUfaAfaAfaUfgaAfucUfL96 | AS2013 | 2123 gAfuCfauaUfuUfaauAfcGfuGfcUfusUfsg | | | | |
| D2014 | S2014 | 1032 AfgCfaCfgUfaUfUfAfaAfauaUfgaUfcUfL96 | AS2014 | 2124 aGfaUfcAfUfAfUfuaaUfaCfgUfgCfusUfsu | | | | |
| D2015 | S2015 | 1033 AfgCfaCfgUfaUfUfAfaAfuaUfUfGfaUfcUfL96 | AS2015 | 2125 aGfaUfcauAfuUfuaaUfaCfgUfgCfusUfsu | | | | |
| D2016 | S2016 | 1034 GfcAfcGfuAfuUfAfAfaUfauGfaAfucUfuGfL96 | AS2016 | 2126 cAfgAfuCfAfUfuaAfuUfuuaAfuAfcGfuGfcsUfsu | | | | |
| D2017 | S2017 | 1035 GfcAfcGfuAfuUfAfAfaAfugaAfucUfuGfL96 | AS2017 | 2127 cAfgAfucaUfaUfuuaAfuAfcGfuGfcsUfsu | | | | |
| D2018 | S2018 | 1036 CfaCfgUfaUfUfAfaAfaUfauUfcUfgCfL96 | AS2018 | 2128 gfCfaGfaUfCfAfuAfuuuAfaCfgUfgsCfsu | | | | |
| D2019 | S2019 | 1037 CfaCfgUfaUfUfAfaAfuauUfcUfgCfL96 | AS2019 | 2129 gCfaGfaucAfuAfuuuAfaCfgUfgsCfsu | | | | |
| D2020 | S2020 | 1038 AfcGfuAfuUfaAfaUfuFfgaUfcUfcAfL96 | AS2020 | 2130 uGfaUfcAfgAfUfCfaUuUfaAfuAfcGfusGfsc | | | | |
| D2021 | S2021 | 1039 AfcGfuAfuUfaAfaUfaUfGfcUfcAfL96 | AS2021 | 2131 uGfcAfgauCfaFfauUfaAfuAfcGfusGfsc | | | | |
| D2022 | S2022 | 1040 CfgUfaUfaAfaUfUfAfgUfaucUfgCfaGfL96 | AS2022 | 2132 cUfgCfaGfAfUfcAfuauUfaAfuAfCfgsUfsg | | | | |
| D2023 | S2023 | 1041 CfgUfaUfaAfaUfUfAfgUfaUfCfugCfaGfL96 | AS2023 | 2133 cUfgCfagaUfCfauaUfuAfaUfaCfgsUfsg | | | | |
| D2024 | S2024 | 1042 GfuUfaUfaAfaUfuFfgaUfucUfgCfAfgGfL96 | AS2024 | 2134 gCfuGfcAfGfAfUfcAfuAfUfuAfaUfaCfsGfsu | | | | |
| D2025 | S2025 | 1043 GfuUfaUfaAfaUfuFfgaUfucUfgCfAfgGfL96 | AS2025 | 2135 gCfuGfcagaUfcAfuAfUfuAfaUfaCfsGfsu | | | | |
| D2026 | S2026 | 1044 UfaUfUfaAfaAfuUfuGfaUfcUfgCfAfgGfcCfL96 | AS2026 | 2136 gGfcCfgCfAfGfAfUfcAfuUfuAfAfuAfcsGfsg | | | | |
| D2027 | S2027 | 1045 UfaUfUfaAfaAfuUfuGfaUfcUfgCfagGfcCfL96 | AS2027 | 2137 gGfcCfgcaGfaUfcaUfuAfAfuAfcsCfsg | | | | |
| D2028 | S2028 | 1046 AfuUfaAfaAfuUfuGfaAfuCfugCfAfgGfcCfL96 | AS2028 | 2138 uGfgCfugCfUfGfCfAfGfaUfcAfuUfuAfasCfsc | | | | |
| D2029 | S2029 | 1047 AfuUfaAfaAfuUfuGfaAfuCfugCfAfgCfcAfL96 | AS2029 | 2139 uGfgCfugcAfgAfucaUfuUfaAfusAfsc | | | | |
| D2030 | S2030 | 1048 UfuUfaAfaAfuGfuGfaAfuFfgcaGfcCfUfL96 | AS2030 | 2140 aUfGgGfcUfGfCfaGfaucAfuuAfuUfaUfsa | | | | |
| D2031 | S2031 | 1049 UfuUfaAfaAfuGfuGfaAfuFfugcaGfccAfL96 | AS2031 | 2141 aUfgGfcugCfaGfaucAfuuAfuUfaUfsa | | | | |
| D2032 | S2032 | 1050 UfaAfaAfuUfGfaAfuCfuGfcagCfcAfUfL96 | AS2032 | 2142 aAfuGfgCfUfGfCfAfgauCfaUfaUfuUfasAfsu | | | | |
| D2033 | S2033 | 1051 UfaAfaAfuUfGfaAfuCfuGfcAfgCfcCfAfUfL96 | AS2033 | 2143 aAfuGfcugCfAfgaucCfaFfaUfuUfasAfsu | | | | |

TABLE 1-continued

RNAi Agents and Results of In Vitro Screening

| Duplex ID | S ID | SEQ ID NO: | Sense strand (S) | AS ID | SEQ ID NO: | Antisense strand (AS) | % of mRNA remained conc. of siRNA | | | IC50 (nM) |
|---|---|---|---|---|---|---|---|---|---|---|
| | | | | | | | 1 nM | 0.1 nM | 0.01 nM | |
| D2034 | S2034 | 1052 | AfaAfaAfuAfgUfaUfCfUfgcCfagcCfaUfuAfL96 | AS2034 | 2144 | uAfaUfgGfcUfgCfagaUfcCfaAfuAfuUfusUfsa | | | | |
| D2035 | S2035 | 1053 | AfaAfuAfuGfuCfUfgCfagGfcCfcfaUfuAfL96 | AS2035 | 2145 | uAfaUfggCfUfgCfagaUfCfafuAfuAfUfusAfsa | | | | |
| D2036 | S2036 | 1054 | AfaUfaUfgGfaUfcUfgGfcAfgcCfaUfuAfaAfL96 | AS2036 | 2146 | uUfaAfuGfGfcUfuGfcagAfucCfaUfaUfusUfsa | | | | |
| D2037 | S2037 | 1055 | AfaUfaUfgGfauCfUfgGfcCfCfAfuAfuUfaAfL96 | AS2037 | 2147 | uUfaAfuggCfuGfcagAfucCfaUfaUfusUfsa | | | | |
| D2038 | S2038 | 1056 | AfaUfuAfuGfaUfcUfgGfcCfagGfccaUfuAfaAfL96 | AS2038 | 2148 | uUfuAfaUfgGfCfcUfgGfccaGfaUfCfaUfuAfusUfsu | | | | |
| D2039 | S2039 | 1057 | AfaUfuAfuGfaUfcUfgGfcCfgfcCfagGfcCfaUfuAfaAfL96 | AS2039 | 2149 | uUfuAfaUfggCfUfgcadCfaUfCfaCfaAfuAfusUfsu | | | | |
| D2040 | S2040 | 1058 | UfaUfgGfaUfcfugGfcCfagGfcCfcauUfaaAfaAfL96 | AS2040 | 2150 | uUfuUfaAfUfUfgGfCfugcAfgAfuCfaUfaUfasUfsu | | | | |
| D2041 | S2041 | 1059 | UfaUfgGfaUfcfugGfcCfAfgGfcCfaUfccfauuAfaAfaAfL96 | AS2041 | 2151 | uUfuUfaauGfgCfugcAfgAfuCfaUfaUfasUfsu | | | | |
| D2042 | S2042 | 1060 | AfuGfaUfCfUfgGfcCfAfgGfcCfAfuUfaAfaAfaAfL96 | AS2042 | 2152 | uUfuUfuAfAfUfggGfcugCfagAfucCfaUfaUfusAfsu | | | | |
| D2043 | S2043 | 1061 | AfuGfaUfCfUfgGfcCfAfgGfccCfaAfufuAfafaAfaAfL96 | AS2043 | 2153 | uUfuUfuaaUfaAfUfgGfcCfugCfagAfucCfaUfusUfsa | | | | |
| D2044 | S2044 | 1062 | UfgGfaUfcUfgGfcAfgGfcCfAfuUfaafuaaAfaAfaGfL96 | AS2044 | 2154 | cUfuUfuuaAfUfAfAfuGfcCfuGfcAfgAfuCfasUfsa | | | | |
| D2045 | S2045 | 1063 | UfgGfaUfcUfgGfcAfgGfcCfAfuUfaAfaAfaAfaGfL96 | AS2045 | 2155 | cUfuUfuuaaAfUfgCfcUfgCfAfgAfuCfasUfsa | | | | |
| D2046 | S2046 | 1064 | GfaUfcUfgGfcCfagGfcCfCfaUfuAfuaaAfaAfaGfL96 | AS2046 | 2156 | uCfuUfuUfUfaUfAfaUfggcUfgCfaGfaUfcsAfsu | | | | |
| D2047 | S2047 | 1065 | GfaUfcUfgGfcCfagGfcCfAfuUfaAfuAfaAfgaCfL96 | AS2047 | 2157 | uCfuUfuuuAfaUfggcUfgCfagGfaUfcsAfsu | | | | |
| D2048 | S2048 | 1066 | AfuCfuGfgCfcAfgGfcCfAfuUfaAfuafaAfaGfaCfL96 | AS2048 | 2158 | gUfgUfcUfuUfaAfuggCfugGfcAfgAfusCfsa | | | | |
| D2049 | S2049 | 1067 | AfuCfuGfgCfcAfgGfcCfAfuUfaAfuAfagAfcfL96 | AS2049 | 2159 | gUfcUfuuuUfaAfugGfcfuuGfcAfgsAfsu | | | | |
| D2050 | S2050 | 1068 | UfCfUfgGfcCfaGfgCfCfAfuUfuAfaaaAfgAfcAfL96 | AS2050 | 2160 | uGfeUfcfuUfUfuUfAfaugGfcCfUfgCfaGfasUfsc | | | | |
| D2051 | S2051 | 1069 | UfcUfgGfcAfgGfcCfAfuUfaAfuAfaAfgAfcAfL96 | AS2051 | 2161 | uGfuGfcuuuUfUfaAfaugGfcCfUfgCfaGfasUfsu | | | | |
| D2052 | S2052 | 1070 | CfuGfgCfcAfgGfcCfAfuUfaAfuAfaAfagacAfCfL96 | AS2052 | 2162 | gUfgGfcUfcUfuUfuUfaauGfgCfuGfcAfgsAfsu | | | | |
| D2053 | S2053 | 1071 | CfuGfcCfaGfgCfcAfuUfaAfuAfaAfgAfcAfCfL96 | AS2053 | 2163 | gUfgUfcuuUfuUfuUfaauGfgCfuuGfcAfgsAfsu | | | | |
| D2054 | S2054 | 1072 | UfgGfcCfaGfcCfaUfaAfuAfaAfagAfcAfcAfL96 | AS2054 | 2164 | uGfuGfucUfcUfUfuUfuaaUfgGfcUfgCfasGfsa | | | | |
| D2055 | S2055 | 1073 | UfgGfcCfaGfcCfaUfuAfaaAfagAfcAfcAfL96 | AS2055 | 2165 | uGfuGfucuUfcUfuUfuaaUfgGfcUfgCfasGfsa | | | | |
| D2056 | S2056 | 1074 | GfcAfgGfcCfaUfuAfAfafaAfagacCfaCfafuFL96 | AS2056 | 2166 | aUfgUfgUfCfUfUfUfuuaAfuGfgCfcuGfcAfsgg | | | | |

TABLE 1-continued

RNAi Agents and Results of In Vitro Screening

| Duplex ID | s ID | SEQ ID NO: | Sense strand (S) | AS ID | SEQ ID NO: | Antisense strand (AS) | % of mRNA remained conc. of siRNA | | | IC50 (nM) |
|---|---|---|---|---|---|---|---|---|---|---|
| | | | | | | | 1 nM | 0.1 nM | 0.01 nM | |
| D2057 | S2057 | 1075 | GfcAfgCfcAfuUfaAfAfaAfaGfAfCfaCfaCfuFL96 | AS2057 | 2167 | aUfgUfgucUfuUfuaaAfaUfgCfuGfcsAfsg | | | | |
| D2058 | S2058 | 1076 | CfaGfcCfaUfuAfAfaAfAfaAfgaCfAfcAfuUfL96 | AS2058 | 2168 | aAfuGfuGfuFfCfuFfuuuAfaUfgGfcUfgsCfsa | | | | |
| D2059 | S2059 | 1077 | CfaGfcCfaUfuAfAfaAfAfaAfgAfCfAfcAfuUfL96 | AS2059 | 2169 | aAfuGfuguCfuUfuuuAfaUfgGfcUfgsCfsa | | | | |
| D2060 | S2060 | 1078 | AfgCfcAfuUfaAfAfaAfAfaAfgAfgAfacaCfaUfuCfL96 | AS2060 | 2170 | gAfaUfgUfgUfcUfuuuUfaAfuGfgCfusGfsc | | | | |
| D2061 | S2061 | 1079 | AfgCfcAfuUfaAfAfAfaAfAfaCfAfCfAfcAfuUfcUfL96 | AS2061 | 2171 | gAfaUfgugUfcUfuuuUfaAfuGfgCfusGfsc | | | | |
| D2062 | S2062 | 1080 | GfcCfaUfuAfaAfuFfaAfAfAfgAfcacAfuUfcUfL96 | AS2062 | 2172 | aGfaAfuGfuFfGfuCfuuuUfaAfuGfgCfcsUfsg | | | | |
| D2063 | S2063 | 1081 | GfcCfaUfuAfaAfaAfaAfAfgAfcAfcAfuCfuGfL96 | AS2063 | 2173 | aGfaAfuguGfuCfuuuUfaAfuGfgsCfsu | | | | |
| D2064 | S2064 | 1082 | CfcAfuUfaAfaAfAfaAfAfgAfacAfuCfuGfL96 | AS2064 | 2174 | cAfgAfauFfGfuFfgUfcuuUfuAfaAfuGfgsCfsu | | | | |
| D2065 | S2065 | 1083 | CfcAfuUfaAfaAfaAfaAfgAfcAfcAfuFfcuGfuGfL96 | AS2065 | 2175 | cAfgAfauGfuGfuFfcuuUfuAfuFfuAfuFfgsGfsu | | | | |
| D2066 | S2066 | 1084 | CfaUfuAfaAfaAfaAfaAfgAfAfcAfcAfcauUfcUfguFfL96 | AS2066 | 2176 | aCfaGfaAfuFfGfuGfucuUfuUfuAfaUfgGfsc | | | | |
| D2067 | S2067 | 1085 | CfaUfuAfaAfuAfaAfAfgAfCfAfcAfuUfcUfcUfL96 | AS2067 | 2177 | aCfaGfaaUfgUfgucUfuUfuAfaUfgGfsc | | | | |
| D2068 | S2068 | 1086 | AfuUfaAfAfaAfAfaGfaFfcAfcAfuUfcUfgFfuAfL96 | AS2068 | 2178 | uAfcAfgAfAfuFfgucUfuUfuUfaAfusGfsg | | | | |
| D2069 | S2069 | 1087 | AfuUfaAfAfAfaAfgaFfGfaCfaCfuUfcUfgFfuAfL96 | AS2069 | 2179 | uAfcAfgaaUfgUfgucUfuUfuUfaAfusGfsg | | | | |
| D2070 | S2070 | 1088 | UfuAfaAfAfaAfAfgaCfaFfAfcAfuFfcUfgFfuAfL96 | AS2070 | 2180 | uUfaCfagaAfuGfgucCfuFfuUfuFfuAfasUfsg | | | | |
| D2071 | S2071 | 1089 | UfuAfaAfAfaAfgAfCfaCfAfcAfuUfcUfgUfaAfL96 | AS2071 | 2181 | uUfaCfagaCfugaAfuGfgucCfuFfuUfuAfasAfsg | | | | |
| D2072 | S2072 | 1090 | UfaAfAfaAfgAfCfaCfaCfuUfcUfgUfaAfL96 | AS2072 | 2182 | uUfuAfcAfCfAfgAfAfugUfgucUfcFfuUfuAfasAfsu | | | | |
| D2073 | S2073 | 1091 | UfaAfaAfgAfCfaCfaCfuUfcUfcuGfuaAfaAfL96 | AS2073 | 2183 | uUfuAfcAfCfAfgAfAfugUfgUfuCfuUfuAfasAfsu | | | | |
| D2074 | S2074 | 1092 | AfaAfaAfaGfAfCfaCfAfCfuUfcuGfuAfaAfL96 | AS2074 | 2184 | uUfuUfaCfAfCfAfgAfAfugUfuFfuFfuUfuAfsAfsa | | | | |
| D2075 | S2075 | 1093 | AfaAfaAfgaCfAfcAfCfuFfgUfCfuFfuFfuGfuAfAfL96 | AS2075 | 2185 | uUfuUfacaGfAfAfugUfgUfcUfuFfuUfusAfsa | | | | |
| D2076 | S2076 | 1094 | AfaAfgAfcAfCfaCfuFfcUfuFfguAfaAfL96 | AS2076 | 2186 | uUfuUfuAfCfAfgAfaAfugUfgUfcUfuFfusAfsa | | | | |
| D2077 | S2077 | 1095 | AfaAfgaCfaCfaCfuFfcUfgUfaAfAfaAfaAfL96 | AS2077 | 2187 | uUfuUfuAfCfAfgAfauGfuGfcCfuUfuUfusUfsa | | | | |
| D2078 | S2078 | 1096 | AfaAfgAfcAfcAfCfuFfuFfguaAfaAfaAfAfL96 | AS2078 | 2188 | uUfuUfuAfCfAfgfaauGfuCfuFfuUfusUfsu | | | | |

TABLE 1-continued

RNAi Agents and Results of In Vitro Screening

| Duplex ID | s ID | SEQ ID NO: | Sense strand (S) | AS ID | SEQ ID NO: | Antisense strand (AS) | % of mRNA remained conc. of siRNA | | | IC50 (nM) |
|---|---|---|---|---|---|---|---|---|---|---|
| | | | | | | | 1 nM | 0.1 nM | 0.01 nM | |
| D2079 | S2079 | 1097 | AfaAfgAfcAfcAfuUfcUfgUfaAfaAfaAfaAfL96 | AS2079 | 2189 | uUfuUfuuaCfaGfaauGfuGfuCfuUfusUfsu | | | | |
| D2080 | S2080 | 1098 | AfaGfaCfaCfaUfuUfcCfuGfuaaAfaAfaAfaAfL96 | AS2080 | 2190 | uUfuUfuUfuAfcAfgaaUfgUfgUfcUfusUfsu | | | | |
| D2081 | S2081 | 1099 | AfaGfaCfaCfaCfaUfuUfcCfuGfuAfaAfaAfaAfaAfL96 | AS2081 | 2191 | uUfuUfuuuAfcAfgaaUfgUfgUfcUfusUfsu | | | | |
| D2082 | S2082 | 1100 | AfgAfcAfcAfuUfcCfuGfuaAfaAfaAfaAfL96 | AS2082 | 2192 | uUfuUfuUfuCfagaAfuGfuGfuCfusUfsu | | | | |
| D2083 | S2083 | 1101 | AfgAfcAfcAfuUfcUfgUfuAfaAfaAfaAfaAfL96 | AS2083 | 2193 | uUfuUfuuuUfaCfagaAfuGfuGfuCfusUfsu | | | | |
| D2084 | S2084 | 1102 | GfaCfaCfaUfuCfUfGfuAfgUfaAfaAfaAfaAfaAfL96 | AS2084 | 2194 | uUfuUfuUfuUfuAfcagAfaUfgUfgUfcsUfsu | | | | |
| D2085 | S2085 | 1103 | GfaCfaCfaUfuCfUfGfuUfaAfaAfaAfaAfaAfL96 | AS2085 | 2195 | uUfuUfuuuUfuAfcagAfaUfgUfgUfcsUfsu | | | | |
| D2086 | S2086 | 1104 | AfcAfcAfuUfcUfgUfUfaAfaAfaAfaAfaAfL96 | AS2086 | 2196 | uUfuUfuUfuUfuAfacaGfaAfuGfuGfusCfsu | | | | |
| D2087 | S2087 | 1105 | AfcAfcAfuUfcUfUfGfuAfaAfaAfaAfaAfL96 | AS2087 | 2197 | uUfuUfuuuUfuUfacaGfaAfuGfuGfusCfsu | | | | |
| D2088 | S2088 | 1106 | CfaCfaUfuCfUfGfuUfaAfaAfaAfaAfaAfL96 | AS2088 | 2198 | uUfuUfuUfuUfuacAfgAfaUfgUfgsUfsc | | | | |
| D2089 | S2089 | 1107 | CfaCfaUfuCfuGfUfGfuUfaAfaAfaAfaAfaAfL96 | AS2089 | 2199 | uUfuUfuUfuUfuuacAfgAfaUfgUfgsUfsc | | | | |
| D2090 | S2090 | 1108 | AfcAfuUfcUfgUfUfaAfaAfaAfaAfaAfL96 | AS2090 | 2200 | uUfuUfuUfuUfuuaCfgAfaAfuGfusGfsu | | | | |
| D2091 | S2091 | 1109 | AfcAfuUfcUfgUfAfaAfaAfaAfaAfaAfL96 | AS2091 | 2201 | uUfuUfuuuUfuUfuuaCfaGfaAfuGfusGfsu | | | | |

Lowercase nucleotides (a, u, g, c) are 2'-O-methyl nucleotides; Nf(e.g., Af) is a 2'-fluoro nucleotide; s is aphosphothiorate linkage; L96 indicates a GalNAc3 ligand.

Example 4

In Vitro Screening of RNAi Agents

Cell Culture and Transfections

Human Hep3B cells or rat H.II.4.E cells (ATCC, Manassas, Va.) were grown to near confluence at 37° C. in an atmosphere of 5% CO2 in RPMI (ATCC) supplemented with 10% FBS, streptomycin, and glutamine (ATCC) before being released from the plate by trypsinization. Transfection was carried out by adding 14.8 µl of Opti-MEM plus 0.2 µl of Lipofectamine RNAiMax per well (Invitrogen, Carlsbad Calif. cat #13778-150) to 5 µl of siRNA duplexes per well into a 96-well plate and incubated at room temperature for 15 minutes. 80 µl of complete growth media without antibiotic containing ~2×104 Hep3B cells were then added to the siRNA mixture. Cells were incubated for either 24 or 120 hours prior to RNA purification. Single dose experiments were performed at 10 nM and 0.1 nM final duplex concentration and dose response experiments were done using 8, 4 fold serial dilutions with a maximum dose of 10 nM final duplex concentration.

Total RNA Isolation Using DYNABEADS mRNA Isolation Kit (Invitrogen, Part #: 610-12)

Cells were harvested and lysed in 150 µl of Lysis/Binding Buffer then mixed for 5 minutes at 850 rpm using an Eppendorf Thermomixer (the mixing speed was the same throughout the process). Ten microliters of magnetic beads and 80 µl Lysis/Binding Buffer mixture were added to a round bottom plate and mixed for 1 minute. Magnetic beads were captured using magnetic stand and the supernatant was removed without disturbing the beads. After removing the supernatant, the lysed cells were added to the remaining beads and mixed for 5 minutes. After removing the supernatant, magnetic beads were washed 2 times with 150 µl Wash Buffer A and mixed for 1 minute. Beads were capture again and supernatant removed. Beads were then washed with 150 µl Wash Buffer B, captured and supernatant was removed. Beads were next washed with 150 µl Elution Buffer, captured and supernatant removed. Beads were allowed to dry for 2 minutes. After drying, 50 µl of Elution Buffer was added and mixed for 5 minutes at 70° C. Beads were captured on magnet for 5 minutes. 40 µl of supernatant was removed and added to another 96 well plate.

cDNA Synthesis Using ABI High Capacity cDNA Reverse Transcription Kit (Applied Biosystems, Foster City, Calif., Cat #4368813)

A master mix of 1 µl 10× Buffer, 0.4 µl 25×dNTPs, 1 µl Random primers, 0.5 µl Reverse Transcriptase, 0.5 µl RNase inhibitor and 1.6 µl of $H_2O$ per reaction were added into 5 µl total RNA. cDNA was generated using a Bio-Rad C-1000 or S-1000 thermal cycler (Hercules, Calif.) through the following steps: 25° C. 10 min, 37° C. 120 min, 85° C. 5 sec, 4° C. hold.

Real Time PCR

2 µl of cDNA were added to a master mix containing 0.50 GAPDH TaqMan Probe (Applied Biosystems Cat #4326317E (human) Cat #4308313 (rodent)), 0.50 TTR TaqMan probe (Applied Biosystems cat #HS00174914_m1 (human) cat #Rn00562124_m1 (rat)) and 5 µl Lightcycler 480 probe master mix (Roche Cat #04887301001) per well in a 384 well plate (Roche cat #04887301001). Real time PCR was done in a Roche LC 480 Real Time PCR machine (Roche). Each duplex was tested in at least two independent transfections and each transfection was assayed in duplicate, unless otherwise noted.

To calculate relative fold change, real time data were analyzed using the ΔΔCt method and normalized to assays performed with cells transfected with 10 nM AD-1955, or mock transfected cells. $IC_{50}$s were calculated using a 4 parameter fit model using XLFit and normalized to cells transfected with AD-1955 (sense sequence: cuuAcGcuGAGuAcuucGAdTsdT (SEQ ID NO: 2202); antisense sequence: UCGAAGuCUcAGCGuAAGdTsdT (SEQ ID NO: 2203)) or naïve cells over the same dose range, or to its own lowest dose. $IC_{50}$s were calculated for each individual transfection as well as in combination, where a single $IC_{50}$ was fit to the data from both transfections.

The results of gene silencing of the exemplary siRNA duplex with various motif modifications of the invention are shown in Table 1 above.

Example 5

In Vitro Silencing Activity of Chemically Modified RNAi Agents that Target TTR The following experiments demonstrated the beneficial effects of chemical modifications, including the introduction of triplet repeat motifs, together with a $GalNAc_3$ ligand, on the silencing activity of RNAi agents that target TTR. The sequences of the agents investigated are provided in Table 2 below. The regions of complementarity to the TTR mRNA are as follows: the region of complementarity of RNAi agents AD-45165, AD-51546 and AD-51547 is GGATGG-GATTTCATGTAACCAAGA (SEQ ID NO: 2204) and the region or complemetarity of RNAi agents AD-45163, AD-51544, and AD-51545 is TTCATGTAACCAAGAG-TATTCCAT (SEQ ID NO: 2205).

Protocol for Assessment of $IC_{50}$ in Hep3B Cells

The $IC_{50}$ for each modified siRNA was determined in Hep3B cells (a human hepatoma cell line) by standard reverse transfection using Lipofectamine RNAiMAX. In brief, reverse transfection was carried out by adding 5 µL of Opti-MEM to 5 µL of siRNA duplex per well into a 96-well plate along with 10 µL of Opti-MEM plus 0.5 µL of Lipofectamine RNAiMax per well (Invitrogen, Carlsbad Calif. cat #13778-150) and incubating at room temperature for 15-20 minutes. Following incubation, 100 µL of complete growth media without antibiotic containing 12,000-15,000 Hep3B cells was then added to each well. Cells were incubated for 24 hours at 37° C. in an atmosphere of 5% $CO_2$ prior to lysis and analysis of TTR and GAPDH mRNA by bDNA (Quantigene). Seven different siRNA concentrations ranging from 10 nM to 0.6 µM were assessed for $IC_{50}$ determination and TTR/GAPDH for siRNA transfected cells was normalized to cells transfected with 10 nM Luc siRNA. The results are shown in Table 2.

Protocol for Assessment of Free-Uptake $IC_{50}$

Free uptake silencing in primary cynomolgus hepatocytes was assessed following incubation with TTR siRNA for either 4 hours or 24 hours. Silencing was measured at 24 hours from the initial exposure. In brief, 96-well culture plates were coated with 0.05%-0.1% collagen (Sigma C3867-1VL) at room temperature, 24 hours prior to the start of the experiment. On the day of assay, siRNAs were diluted in pre-warmed Plating Media consisting of DMEM supplemented with GIBCO's Maintenance Media Kit (Serum-Free, Life Technologies CM4000), and added to the collagen-coated 96-well culture plates. Cryopreserved primary cynomolgus hepatocytes were rapidly thawed in a 37° C. water bath, and immediately diluted in Plating Media to a concentration of 360,000 cells/mL. A volume of cell suspension was gently pipetted on top of the pre-plated siRNAs such that the final cell count was 18,000 cells/well. The plate was lightly swirled to mix and spread cells evenly across the wells and placed in a 37° C., 5% $CO_2$ incubator for 24 hours prior to lysis and analysis of TTR and GAPDH mRNA by bDNA (Quantigene, Affymetrix). In the case of the 4 h incubation with siRNA, the media was decanted after 4 hours of exposure to the cells, and replaced with fresh Plating Media for the remaining 20 hours of incubation. Downstream analysis for TTR and GAPDH mRNA was the same as described above. For a typical dose response curve, siRNAs were titrated from 1 uM to 0.24 nM by 4 fold serial dilution.

TABLE 2

In vitro Activity Summary for Alternating TTR-GalNAc and Variants with Triplet Motifs

| Duplex ID | S (5'-3') | AS (5'-3") | Free-Uptake IC50 (µM) 4 h | Free-Uptake IC50 (µM) 24 h | Hep3B IC50 (nM) |
|---|---|---|---|---|---|
| AD-45163 | AfuGfuAfaCfcAfaGfaGfuAfuU fcCfaUfL96 (SEQ ID NO: 2206) | aUfgGfaAfuAfcUfcUfuGfgUfu AfcAfusGfsa (SEQ ID NO: 2212) | 0.04101 | 0.00820 | 0.0115 |
| AD-51544 | AfuGfuAfaCfcAfAfGfaGfuA fuucCfaUfL96 (SEQ ID NO: 2207) | aUfgGfAfAfuAfcUfcuuGfgUfuA fcAfusGfsa (SEQ ID NO: 2213) | 0.00346 | 0.00374 | 0.0014 |
| AD-51545 | AfuGfuAfAfCfcAfAfGfaGfuAf uUfcCfaUfL96 (SEQ ID NO: 2208) | aUfgGfaAfuAfcUfcuuGfguuA fcAfusGfsa (SEQ ID NO: 2214) | 0.00395 | 0.00389 | 0.0018 |
| AD-45165 | UfgGfgAfuUfuCfaUfgUfaAf cCfaAfgAfL96 (SEQ ID NO: 2209) | uCfuUfgGfuUfaCfaUfgAfaAfuC fcCfasUfsc (SEQ ID NO: 2215) | 0.02407 | 0.00869 | 0.0112 |
| AD-51546 | UfgGfGfAfuUfuCfAfUfgUfaA fcCfAfAfgAfL96 (SEQ ID NO: 2210) | uCfuugGfuUfaCfaugAfaAf uccCfasUfsc (SEQ ID NO: 2216) | 0.00317 | 0.00263 | 0.0017 |
| AD-51547 | UfgGfgAfuUfuCfAfUfgUfaa cCfaAfgAfL96 (SEQ ID NO: 2211) | uCfuUfgGfUfUfaCfaugAfaAf uCfcCfasUfsc (SEQ ID NO: 2217) | 0.00460 | 0.00374 | 0.0028 |

Lowercase nucleotides (a, u, g, c) indicate 2'-O-methyl nucleotides; Nf (e.g., Af) indicates a 2'-fluoro nucleotide; s indicates a phosphothiorate linkage; L96 indicates a GalNAc₃ ligand; bold nucleotides indicate changes relative to the corresponding parent agent. Each bold nucleotide is at the center of a triplet motif.

The results are provided in Table 2 and demonstrate that modified RNAi agents that target TTR provide enhanced silencing activity.

Results: Improved Activity of Modified RNAi Agents

Figure 5:
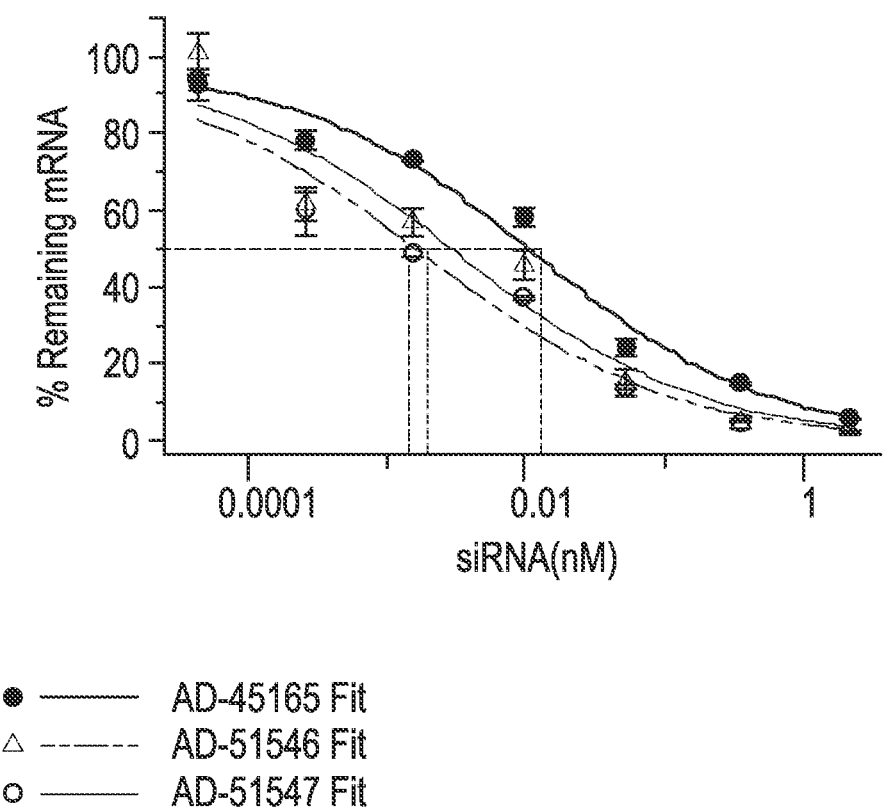
FIG. 5 is a graph depicting improved silencing activity of RNAi agents modified relative to the parent AD-45165.

Parent RNAi agents with alternating chemical modifications and a GalNAc₃ ligand provided an $IC_{50}$ in Hep3B cells of about 0.01 nM. As shown in FIGS. 4-5 and in Table 2, agents modified relative to the parent agents, for example, by the addition of one or more repeating triplets of 2'-fluoro and 2'-O-methyl modifications, showed unexpectedly enhanced silencing activity, achieving $IC_{50}$ values in Hep3B cells that were 5-8 fold better than the corresponding parent agent.

Results: Free Uptake $IC_{50}$s in Hep3B Cells

Figure 6:
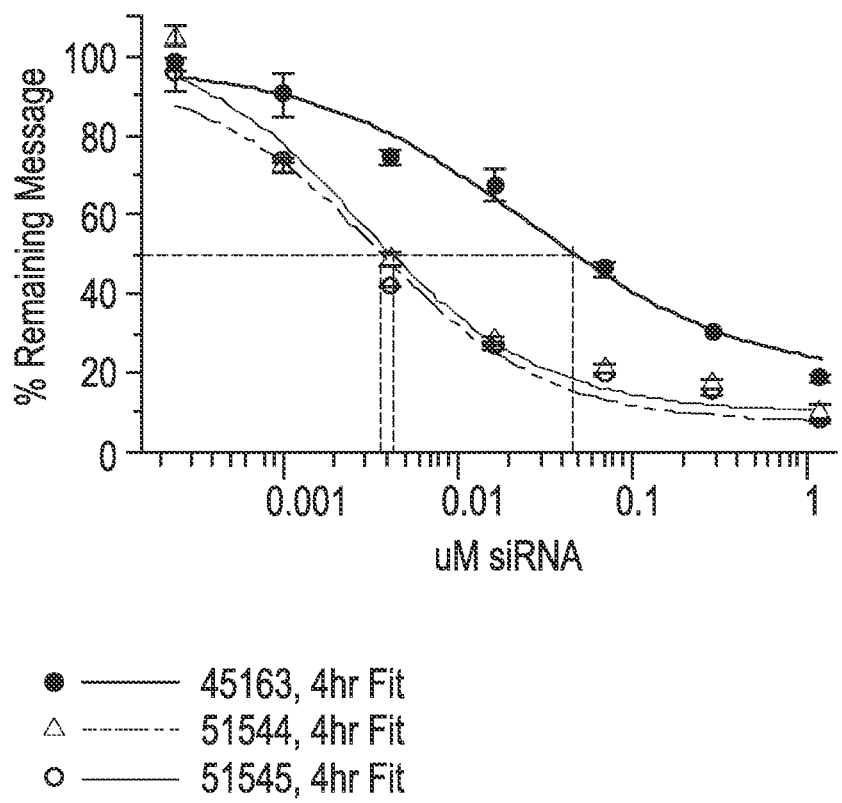
FIG. 6 is a graph depicting improved free uptake silencing following 4 hour incubation with RNAi agents modified relative to the parent AD-45163.
Figure 7:
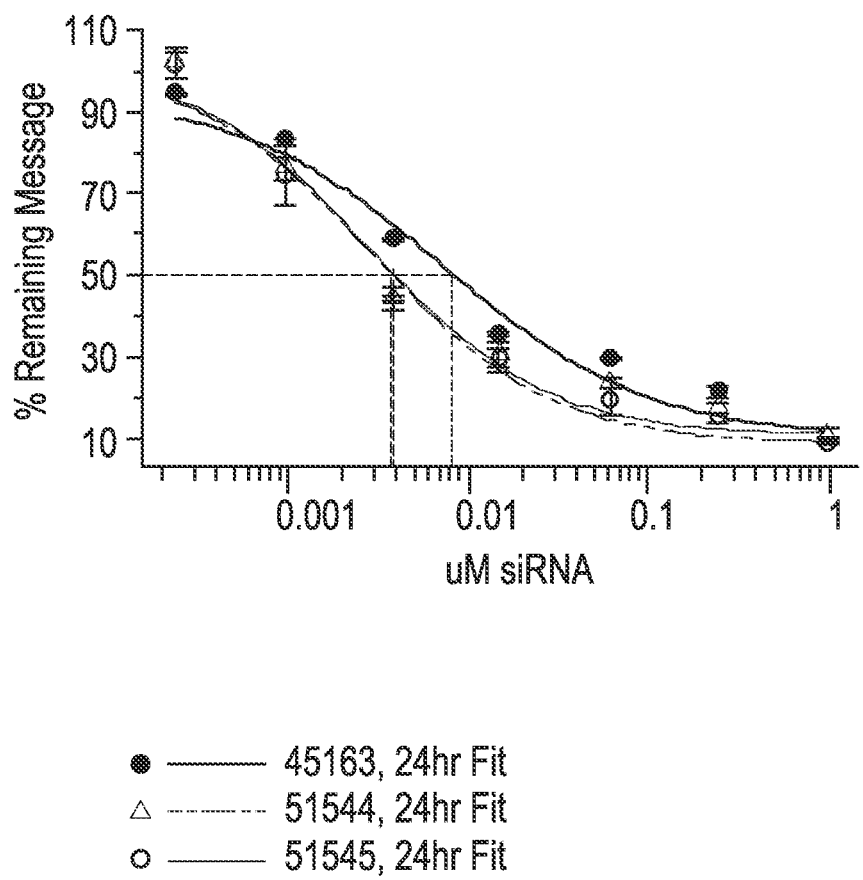
FIG. 7 is a graph depicting improved free uptake silencing following 24 hour incubation with RNAi agents modified relative to the parent AD-45163.

As shown in Table 2 and FIGS. 6-7, RNAi agents modified relative to the parent AD-45163 also showed enhanced free uptake silencing. The modified agents showed more than double the silencing activity of the parent after a 24 hour incubation period and nearly 10 times the silencing activity of the parent after a 4 hour incubation period.

Figure 8:
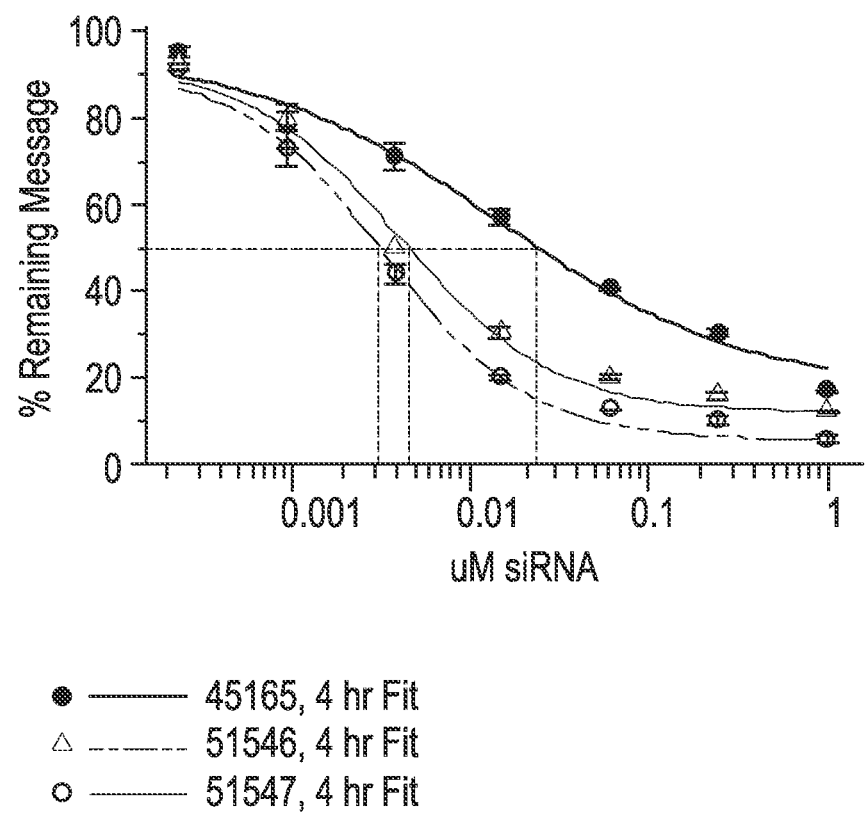
FIG. 8 is a graph depicting improved free uptake silencing following 4 hour incubation with RNAi agents modified relative to the parent AD-45165.

As shown in Table 2 and FIGS. 8-9, RNAi agents modified relative to the parent AD-45165 also showed enhanced free uptake silencing. The modified agents showed 2-3 times the silencing activity of the parent after a 24 hour incubation period and 5-8 times the silencing activity of the parent after a 4 hour incubation period.

Taken collectively, these results demonstrate that the modified RNAi agents presented herein, e.g., AD-51544, AD-51545, AD-51546, and AD-51547, all showed unexpectedly good inhibition of TTR mRNA in in vitro silencing experiments.

Example 6

TTR mRNA Silencing and TTR Protein Suppression in Transgenic Mice

To assess the efficacy of the RNAi agents AD-45163, AD-51544, AD-51545, AD45165, AD-51546, and AD-51547, these agents were administered to transgenic mice that express human transthyretin with the V30M mutation (see Santos, S D., Fernaandes, R., and Saraiva, M J. (2010) *Neurobiology of Aging*, 31, 280-289). The V30M mutation is known to cause familial amyloid polyneuropathy type I in humans. See, e.g., Lobato, L. (2003) *J Nephrol.*, 16(3):438-42.

The RNAi agents (in PBS buffer) or PBS control were administered to mice (2 male and 2 female) of 18-24 months of age in a single subcutaneous dose of 5 mg/kg or 1 mg/kg. After approximately 48 hours, mice were anesthetized with 200 µl of ketamine, and then exsanguinated by severing the right caudal artery. Whole blood was isolated and plasma was isolated and stored at −80° C. until assaying. Liver tissue was collected, flash-frozen and stored at −80° C. until processing.

Efficacy of treatment was evaluated by (i) measurement of TTR mRNA in liver at 48 hours post-dose, and (ii) measurement of TTR protein in plasma at pre-bleed and at 48 hours post-dose. TTR liver mRNA levels were assayed utilizing the Branched DNA assays—QuantiGene 2.0 (Panomics cat #: QS0011). Briefly, mouse liver samples were ground and tissue lysates were prepared. Liver lysis mixture (a mixture of 1 volume of lysis mixture, 2 volume of nuclease-free water and 10 ul of Proteinase-K/ml for a final concentration of 20 mg/ml) was incubated at 65° C. for 35 minutes. 20 µl of Working Probe Set (TTR probe for gene target and GAPDH for endogenous control) and 80 ul of tissue-lysate were then added into the Capture Plate. Capture Plates were incubated at 55° C.±1° C. (aprx. 16-20 hrs). The next day, the Capture Plates were washed 3 times with 1× Wash Buffer (nuclease-free water, Buffer Component 1 and Wash Buffer Component 2), then dried by centrifuging for 1 minute at 240 g. 100 µl of pre-Amplifier Working Reagent was added into the Capture Plate, which was sealed with aluminum foil and incubated for 1 hour at 55° C.±1° C. Following 1 hour incubation, the wash step was repeated, then 100 µl of Amplifier Working Reagent was added. After 1 hour, the wash and dry steps were repeated, and 100 µl of Label Probe was added. Capture plates were incubated 50° C.±1° C. for 1 hour. The plate was then washed with 1× Wash Buffer, dried and 100 μl Substrate was added into the Capture Plate. Capture Plates were read using the SpectraMax Luminometer following a 5 to 15 minute incubation. bDNA data were analyzed by subtracting the average background from each triplicate sample, averaging the resultant triplicate GAPDH (control probe) and TTR (experimental probe) values, and then computing the ratio: (experimental probe-background)/(control probe-background).

Plasma TTR levels were assayed utilizing the commercially available kit "AssayMax Human Prealbumin ELISA Kit" (AssayPro, St. Charles, Mo., Catalog #EP3010-1) according to manufacturer's guidelines. Briefly, mouse plasma was diluted 1:10,000 in 1× mix diluents and added to pre-coated plates along with kit standards, and incubated for 2 hours at room temperature followed by 5× washes with kit wash buffer. Fifty microliters of biotinylated prealbumin antibody was added to each well and incubated for 1 hr at room temperature, followed by 5× washes with wash buffer. Fifty microliters of streptavidin-peroxidase conjugate was added to each well and plates were incubated for 30 minutes at room temperature followed by washing as previously described. The reaction was developed by the addition of 50 μl/well of chromogen substrate and incubation for 10 minutes at room temperature with stopping of reaction by the addition of 50 μl/well of stop solution. Absorbance at 450 nm was read on a Versamax microplate reader (Molecular Devices, Sunnyvale, Calif.) and data were analyzed utilizing the Softmax 4.6 software package (Molecular Devices).

Figure 11:
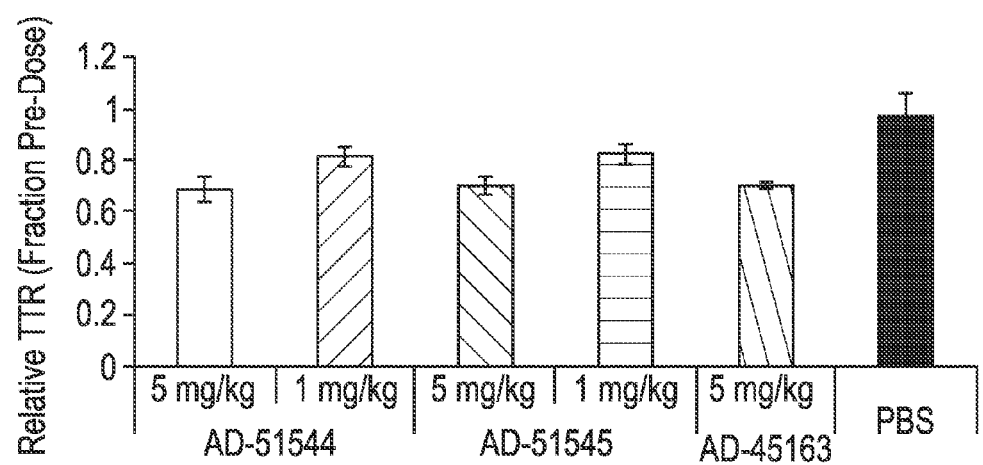
FIG. 11 is a graph depicting TTR protein suppression in transgenic mice that express hTTR V30M following administration of a single subcutaneous dose of 5 mg/kg or 1 mg/kg of RNAi agents AD-51544, AD-51545, or AD-45163.
Figure 12:
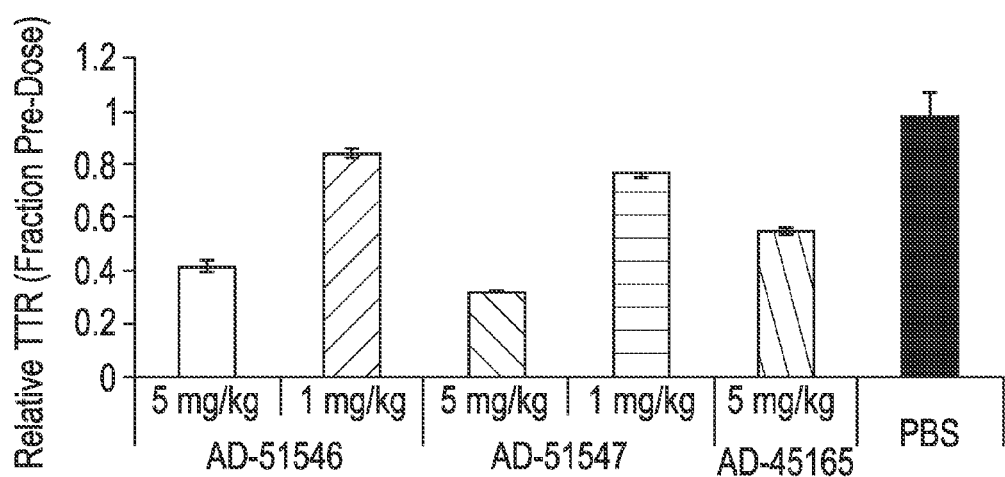
FIG. 12 is a graph depicting TTR protein suppression in transgenic mice that express hTTR V30M following administration of a single subcutaneous dose of 5 mg/kg or 1 mg/kg of RNAi agents AD-51546, AD-51547, or AD-45165.

The results are shown in FIGS. 10-12. FIG. 10 shows that the RNAi agents modified relative to the parent agents AD-45163 and AD-45165 showed RNA silencing activity that was similar or more potent compared with that of the parent agents. FIG. 11 shows that the agents AD-51544 and AD-51545 showed dose dependent silencing activity and that the silencing activity of these agents at a dose of 5 mg/kg was similar to that of the corresponding parent AD-45163. FIG. 12 shows that the agents AD-51546 and AD-51547 also showed dose-dependent silencing activity. Furthermore, the silencing activity of AD-51546 and AD-51547 at a dose of 5 mg/kg was superior to that of the corresponding parent AD-45165.

Example 7

Serum and Liver Pharmacokinetic Profiles of RNAi Agents that Target TTR in Mice To assess the pharmacokinetic profiles of the RNAi agents AD-45163, AD-51544, AD-51545, AD-51546, and AD-51547, these agents, in PBS buffer, were administered to C57BL/6 mice using a single IV bolus or subcutaneous (SC) administration. The plasma concentrations and liver concentrations of the agents were assessed at various timepoints after the administration.

The plasma pharmacokinetic parameters are presented in Tables 3 and 4 below. The mean resident time (MRT) in plasma was about 0.2 hours after IV dosing and about 1 hour after SC dosing. At a dose of 25 mg/kg, the agents AD-51544, AD-51545, AD-51546, and AD-51547 showed similar plasma pharmacokinetic properties. Each of these agents had more than 75% bioavailability from the subcutaneous space. Their bioavailability was superior to that of the parent agent AD-45163 that was administered at a higher dose of 30 mg/kg. The subcutaneous bioavailability of AD-51544 and AD-51547 was about 100%, whereas that of AD-51545 was 90% and that of and AD-51546 was 76%.

TABLE 3

Summary of Plasma PK Parameter Estimates After SC Administration of TTR-GalNAc siRNAs in Mice

| Parameter | 30 mpk AD-45163 (h/c TTR-GalNAc) | 25 mpk AD-51544 (h/c TTR-GalNAc) | 25 mpk AD-51545 (h/c TTR-GalNAc) | 25 mpk AD-51546 (h/c TTR-GalNAc) | 25 mpk AD-51547 (h/c TTR-GalNAc) |
|---|---|---|---|---|---|
| Plasma Tmax (h) | 0.25 | 1 | 0.5 | 1 | 0.5 |
| Plasma Cmax (μg/mL) | 9.6 | 11.7 | 10.9 | 11.7 | 12.1 |
| Plasma AUC (h*μg/mL) | 12.4 | 21.9 | 19.9 | 20.9 | 25.3 |
| $F_{sc}$(%) | 79 | 100 | 90.1 | 76.0 | 99.2 |

TABLE 4

Plasma siRNA PK Parameters in Mice after an IV Bolus or SC Dose of AD-51544, 51545, 51546 or 51547 at 25 mg/kg

| | Test Article | | | | | | | |
|---|---|---|---|---|---|---|---|---|
| | AD-51544 | | AD-51545 | | AD-51546 | | AD-51547 | |
| siRNA Dose (mg/kg) | 25 | | 25 | | 25 | | 25 | |
| Route of Administration | IV | SC | IV | SC | IV | SC | IV | SC |
| $t_{max}$ (h) | 0.083 | 1 | 0.083 | 0.5 | 0.083 | 1 | 0.083 | 0.5 |
| $C_{max}$ (μg/mL) | 96.5[a] | 11.7 | 108[a] | 10.9 | 128[a] | 10.9 | 123[a] | 12.1 |
| $AUC_{0-last}$ (h · μg/mL) | 21.6 | 21.9 | 22.1 | 19.9 | 27.5 | 20.9 | 25.5 | 25.3 |
| $MRT_{0-last}$ (h) | 0.17 | 1.2 | 0.16 | 1.1 | 0.22 | 1.4 | 0.19 | 1.3 |
| Apparent $t_{1/2\beta}$ (h)[b] | ND | ND | ND | 0.49 | ND | 1.2 | ND | 0.56 |
| Fsc (%)[c] | — | 102 | — | 90.1 | — | 76.0 | — | 99.2 |

[a]Concentration at the 1$^{st}$ sampling time (5 min) after IV dosing

[b]Apparent elimination half-life ($t_{1/2\beta}$) could not be determined (ND) for all 4 test articles after IV dosing as the terminal phase of the concentration-time profiles was not well defined, as a result, the $t_{1/2\beta}$-associated PK parameters (eg, $AUC_{0-\infty}$, CL and Vss) were not reported.

[c]SC bioavailability, calculated as percentage ratio of $AUC_{0-last}$ after SC and IV dosing at 25 mg/kg The results also indicated that the RNAi agents AD-45163, AD-51544, AD-51545, AD-51546, and AD-51547 achieved similar or higher concentrations in the liver when administered subcutaneously than when administered by IV bolus. The liver pharmacokinetic parameters are presented in Tables 5 and 6 below. The peak concentration ($C_{max}$) and area under the curve ($AUC_{0\text{-}last}$) in the liver were two to three times higher after subcutaneous administration as compared with IV administration of the same agent at the same dose. Liver exposures were highest for AD-51547 and lowest for AD-51545. The mean resident time (MRT) and elimination half-life were longer for AD-51546 and AD-51547 compared with AD-51544 and AD-51545. Following subcutaneous administration, the approximate MRTs were 40 hours for AD-51546 and 25 hours for AD-51547, whereas the MRTs for AD-51544 and AD-51545 were lower (about 6-9 hours). The elimination half life of AD-51546 and AD-51547 was also higher (41-53 hours) than was the elimination half life of AD-51544 and AD-51545 (6-10 hours).

TABLE 5

Summary of Liver PK Parameter Estimates After
SC Administration of TTR-GalNAc siRNAs in Mice

| Parameter | 30 mpk AD-45163 (h/c TTR-GalNAc) | 25 mpk AD-51544 (h/c TTR-GalNAc) | 25 mpk AD-51545 (h/c TTR-GalNAc) | 25 mpk AD-51546 (h/c TTR-GalNAc) | 25 mpk AD-51547 (h/c TTR-GalNAc) |
|---|---|---|---|---|---|
| Liver Tmax (h) | 8 | 4 | 4 | 2 | 8 |
| Liver Cmax (µg/g) | 313 | 126 | 80 | 117 | 174 |
| Liver AUC (h*µg/g) | 4519 | 1092 | 763 | 2131 | 4583 |

TABLE 6

Liver siRNA PK Parameters in Mice after an IV Bolus or
SC Dose of AD-51544, 51545, 51546 or 51547 at 25 mg/kg

| | Test Article | | | | | | | |
|---|---|---|---|---|---|---|---|---|
| | AD-51544 | | AD-51545 | | AD-51546 | | AD-51547 | |
| siRNA Dose (mg/kg) | 25 | | 25 | | 25 | | 25 | |
| Route of Administration | IV | SC | IV | SC | IV | SC | IV | SC |
| $t_{max}$ (h) | 1 | 4 | 1 | 4 | 4 | 2 | 2 | 8 |
| $C_{max}$ (µg/g) | 67.9 | 126 | 37.0 | 80.5 | 35.3 | 117 | 73.8 | 174 |
| $AUC_{0\text{-}last}$ (h·µg/g) | 632 | 1092 | 324 | 763 | 984 | 2131 | 1429 | 4583 |
| $MRT_{0\text{-}last}$ (h) | 8.7 | 6.5 | 5.9 | 8.5 | 45.7 | 40.2 | 29.4 | 25.3 |
| Apparent $t_{1/2\beta}$ (h) | 8.1 | 8.2 | 5.7 | 10.0 | 51.1 | 45.3 | 41.1 | 52.7 |

Example 8

In Vitro Stability of RNAi Agents in Monkey Serum

The serum stability of RNAi agents AD-51544, AD-51545, AD-51546, and AD-51547 was also assessed in monkeys. The results demonstrated that the antisense and sense strands of AD-51544, AD-51545, and AD-51547 showed serum stability over a period of about 24 hours (data not shown).

Example 9

RNAi Agents Produce Lasting Suppression of TTR Protein in Non-Human Primates

Figure 13:
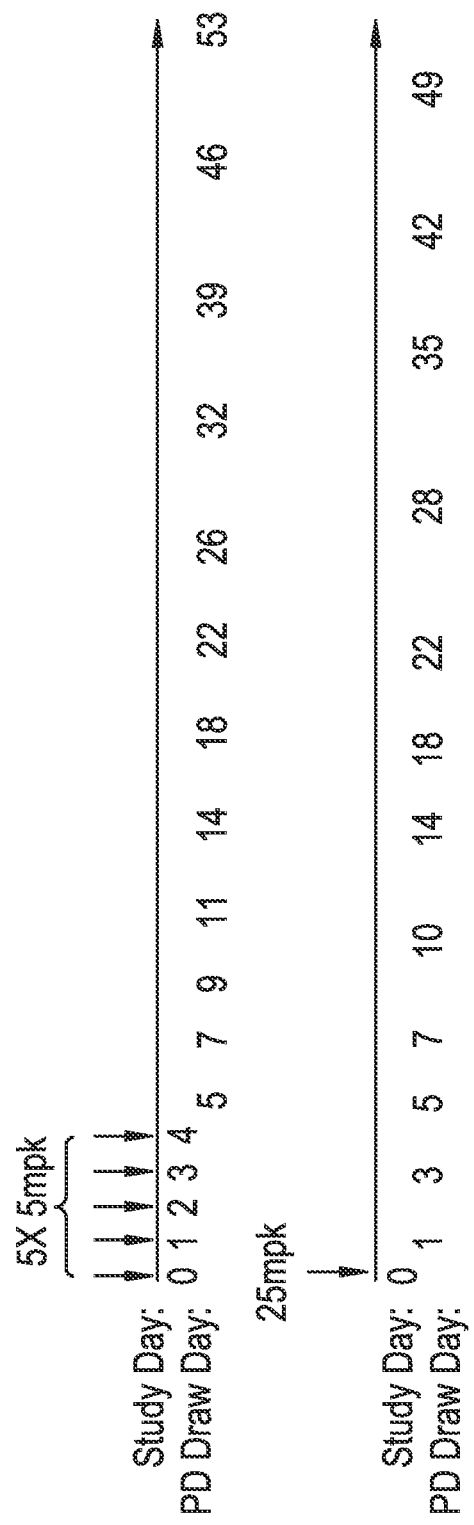
FIG. 13 depicts the protocol for post-dose blood draws in monkeys that received 5×5 mg/kg RNAi agent (top line) or 1×25 mg/kg RNAi agent (bottom line).

The RNA silencing activity of RNAi agents AD-45163, AD-51544, AD-51545, AD-51546, and AD-51547 was assessed by measuring suppression of TTR protein in serum of cynomologous monkeys following subcutaneous administration of five 5 mg/kg doses (one dose each day for 5 days) or a single 25 mg/kg dose. Pre-dose TTR protein levels in serum were assessed by averaging the levels at 11 days prior to the first dose, 7 days prior to the first dose, and 1 day prior to the first dose. Post-dose serum levels of TTR protein were assessed by determining the level in serum beginning at 1 day after the final dose (i.e., study day 5 in the 5×5 mg/kg group and study day 1 in the 1×25 mg/kg group) until 49 days after the last dose (i.e., study day 53 in the 5×5 mg/kg group and study day 49 in the 1×25 mg/kg group). See FIG. 13.

TTR protein levels were assessed as described in Example 6. The results are shown in FIG. 14 and in Tables 7 and 8.

A maximal suppression of TTR protein of up to about 50% was achieved in the groups that received 25 mg/kg of AD-45163, AD-51544, AD-51546, and AD-51547 (see Table 8). A greater maximal suppression of TTR protein of about 70% was achieved in the groups that received 5×5 mg/kg of AD-45163, AD-51544, AD-51546, and AD-51547 (see Table 7). The agent AD-51545 produced a lesser degree of suppression in both administration protocols. Significant suppression of about 20% or more persisted for up to 49 days after the last dose of AD-51546 and AD-51547 in both the 1×25 mg/kg and 5×5 mg/kg protocols. Generally, better suppression was achieved in the 5×5 mg/kg protocol than in the 1×25 mg/kg protocol.

TABLE 7

Fraction Serum Transthyretin Relative to Pre-dose in Cynomolgus Monkeys (5 mg/kg daily for 5 days)

| | D-11 | D-7 | D-1 | D5 | D7 | D9 | D11 | D14 | D18 | D22 | D26 | D32 | D39 | D46 | D53 |
|---|---|---|---|---|---|---|---|---|---|---|---|---|---|---|---|
| AD-45163 | 0.98 | 0.99 | 1.03 | 0.71 | 0.52 | 0.40 | 0.34 | 0.27 | 0.31 | 0.39 | 0.48 | 0.64 | 0.68 | 0.81 | 0.88 |
| AD-51544 | 1.02 | 0.99 | 0.99 | 0.60 | 0.47 | 0.37 | 0.35 | 0.39 | 0.48 | 0.58 | 0.66 | 0.74 | 0.83 | 0.91 | 0.92 |
| AD-51545 | 1.03 | 0.97 | 1.00 | 0.73 | 0.65 | 0.63 | 0.69 | 0.68 | 0.78 | 0.87 | 0.97 | 1.00 | 1.03 | 1.06 | 1.09 |
| AD-51546 | 1.01 | 0.97 | 1.02 | 0.59 | 0.42 | 0.35 | 0.30 | 0.32 | 0.43 | 0.58 | 0.66 | 0.77 | 0.92 | 0.93 | 0.97 |
| AD-51547 | 0.99 | 0.99 | 1.02 | 0.74 | 0.54 | 0.41 | 0.34 | 0.34 | 0.39 | 0.49 | 0.51 | 0.53 | 0.65 | 0.70 | 0.77 |

TABLE 8

Fraction Serum Transthyretin Relative to Pre-dose in Cynomolgus Monkeys (25 mg/kg)

| | D-11 | D-7 | D-1 | D1 | D3 | D5 | D7 | D10 | D14 | D18 | D22 | D28 | D35 | D42 | D49 |
|---|---|---|---|---|---|---|---|---|---|---|---|---|---|---|---|
| AD-45163 | 1.04 | 1.01 | 0.95 | 0.99 | 0.84 | 0.67 | 0.57 | 0.44 | 0.45 | 0.51 | 0.58 | 0.66 | 0.72 | 0.78 | 0.85 |
| AD-51544 | 1.01 | 1.04 | 0.95 | 0.92 | 0.69 | 0.57 | 0.49 | 0.48 | 0.56 | 0.65 | 0.69 | 0.77 | 0.83 | 0.87 | 0.94 |
| AD-51545 | 0.98 | 1.02 | 0.99 | 0.87 | 0.77 | 0.69 | 0.71 | 0.72 | 0.84 | 0.90 | 0.92 | 0.99 | 1.00 | 1.00 | 1.00 |
| AD-51546 | 1.04 | 1.03 | 0.93 | 0.89 | 0.71 | 0.62 | 0.53 | 0.50 | 0.55 | 0.70 | 0.70 | 0.69 | 0.72 | 0.79 | 0.84 |
| AD-51547 | 0.96 | 1.03 | 1.01 | 1.19 | 0.90 | 0.70 | 0.54 | 0.48 | 0.50 | 0.50 | 0.52 | 0.58 | 0.62 | 0.70 | 0.72 |

Example 10

Tolerability of RNAi Agents that Target TTR

In Cytokine Evaluation in Whole Blood Assay

To assess the tolerability of RNAi agents that target TTR (including AD-45163, AD-51544, AD-51545, AD-51546, and AD-51547), each agent was tested in a whole blood assay using blood from three human donors. The agents were either 300 nM DOTAP transfected or 1 μM without transfection reagent (free siRNA). There was less than a two fold change for the following cytokines/chemokines: G-CSF, IFN-γ, IL-10, IL-12 (p70), IL1β, IL-1ra, IL-6, IL-8, IP-10, MCP-1, MIP-1α, MIP-1β, TNFα. (Results not shown).

In Vivo Evaluation

To assess in vivo tolerability, RNAi agents were injected subcutaneously in CD1 mice at a dose of 125 mg/kg. No cytokine induction was observed at 2, 4, 6, 24, or 48 hours after subcutaneous injection of AD-45163. No significant cytokine induction was observed at 6 or 24 hours after subcucutaneous injection of AD-51544, AD-51545, AD-51546, or AD-51547.

To further assess in vivo tolerability, multiple RNAi agents (including AD-45163, AD-51544, AD-51545, AD-51546, and AD-51547) were tested by subcutaneous injection of 5 and 25 mg in non-human primates (cynomologous monkeys) with dose volumes between 1-2 ml per site. No erythema or edema was observed at injection sites.

Single SC Dose Rat Tolerability Study

To assess toxicity, rats were injected with a single subcutaneous dose of 100, 250, 500, or 750 mg/kg of AD-45163 (see Table 9). The following assessments were made: clinical signs of toxicity, body weight, hematology, clinical chemistry and coagulation, organ weights (liver & spleen); gross and microscopic evaluation (kidney, liver, lung, lymph node, spleen, testes, thymus, aorta, heart, intestine (small and large).

TABLE 9

Single SC Dose Rat Tolerability Study: 100, 250, 500 & 750 mg/kg of AD-45163 in Sprague Dawley Rats

| Group | Dose Level (mg/kg) | Dose Volume (ml/kg) | Route & Regimen | No. Male Sprague Dawley Rats | Day of Necropsy |
|---|---|---|---|---|---|
| PBS | 0 | 10 | SC Injection Day 1 (2 sites) | 7/group (5 Tox animals, 2 TK animals) | Day 4 |
| AD-45163 Parent | 100 | | | | |
| | 250 | | | | |
| | 500 | | | | |
| | 750 | | | | |

The results showed no test article-related clinical signs of toxicity, effects on body weight, organ weights, or clinical chemistry. No histopathology was observed in heart, kidneys, testes, spleen, liver, and thymus. There was a non-adverse, slight test article-related increase in WBC (↑68%, primarily attributed to increase in NEUT and MONO) at 750 mg/kg. These results indicate that a single-dose of up to 750 mg/kg is well tolerated in rats.

Tolerability of Repeated Subcutaneous Administrations in Rats

To assess the tolerability of repeated subcutaneous administrations of AD-45163, daily subcutaneous injections of 300 mg/kg were given for 5 days, and a necropsy was performed on day 6. The study design is shown in Table 10.

TABLE 10

Five Day Repeat Dose Tolerability Study in Rat

| Group | Dose Level (kmg/kg | Conc (mg/mL) | No of Tox Animals | Nx Day 6 |
|---|---|---|---|---|
| PBS | 0 | 0 | 2M, 2F | 2M, 2F |
| AD-45163 | 300 | 150 | 2M, 2F | 2M, 2F |

The following outcome variables were assessed: clinical signs, body weights, hematology, clinical chemistry and coagulation, organ weights, gross and microscopic evaluation (liver, spleen, kidney, heart, GI tract and first and last injection site). The results showed no test article-related clinical signs, body weight or organ weight effects, and also no test article-related findings in clinical hematology or chemistry. There was a possible slight prolongation of activated partial thromboplastin time (APTT) on day 6 (20.4 vs. 17.4 sec). Histopathology revealed no test article-related findings in the liver, spleen, heart, and GI tract. In the kidney, minimal to slight hypertrophy of the tubular epithelium (not adverse) was observed. At the last injection site, there was minimal multifocal mononuclear infiltration, not adverse. These results indicate that five daily 300 mg/kg doses of the parent RNAi agent AD-45163 are well tolerated in rats.

Example 11

RNAi Agents Produce Lasting Suppression of TTR Protein in Non-Human Primates

The RNA silencing activity of RNAi agent AD-51547 was assessed by measuring suppression of TTR protein in the serum of cynomologous monkeys following subcutaneous administration of a "loading phase" of the RNAi agent: five daily doses of either 2.5 mg/kg, 5 mg/kg or 10 mg/kg (one dose each day for 5 days) followed by a "maintenance phase" of the RNAi agent: weekly dosing of either 2.5 mg/kg, 5 mg/kg or 10 mg/kg for 4 weeks. Pre-dose TTR protein levels in serum were assessed by averaging the levels at 11 days prior to the first dose, 7 days prior to the first dose, and 1 day prior to the first dose. Post-dose serum levels of TTR protein were assessed by determining the level in serum relative to pre-dose beginning at 1 day after the loading phase was completed until 40 days after the last dose of the maintenance phase (i.e., study day 70).

Figure 15:
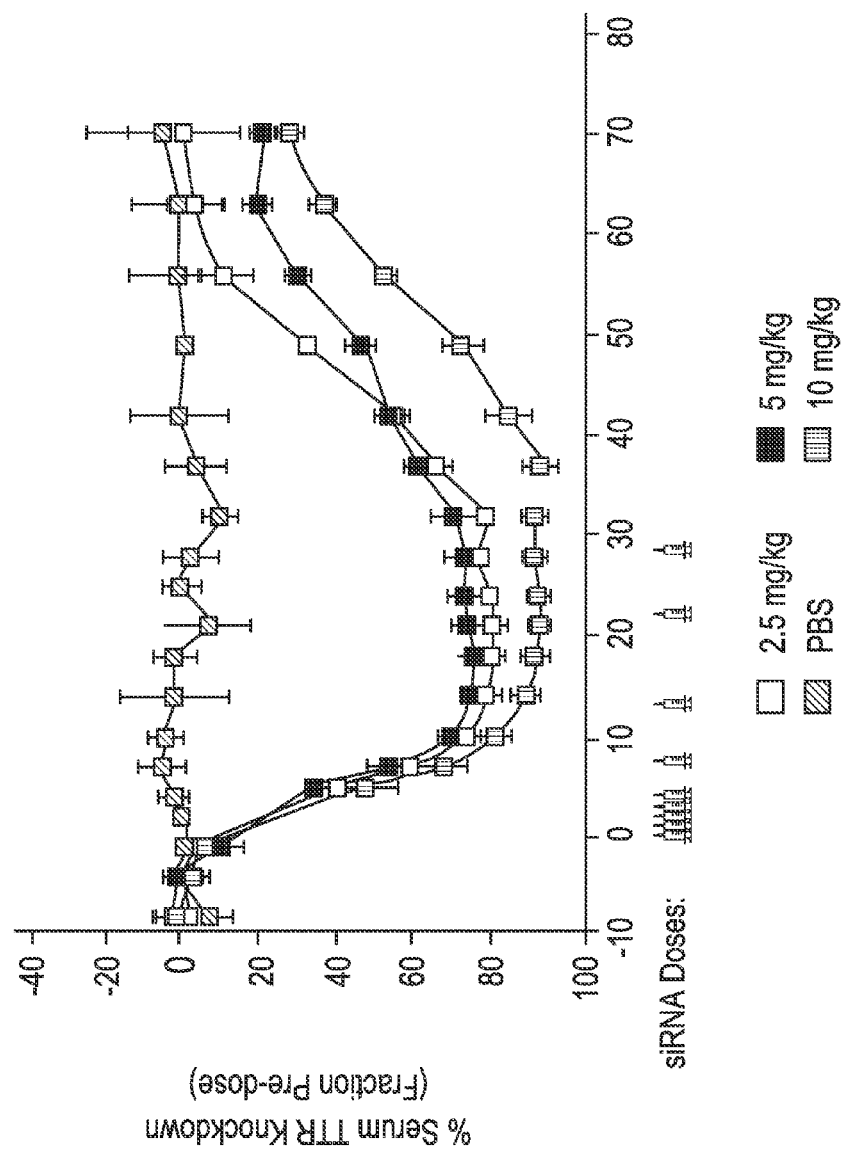
FIG. 15 is a graph depicting suppression of TTR protein in non-human primates following subcutaneous administration of AD-51547 at 2.5 mg/kg (white squares), 5 mg/kg (black squares) or 10 mg/kg (patterned squares) per dose, or administration of PBS as a negative control (gray squares).

TTR protein levels were assessed as described in Example 6. The results are shown in FIG. 15.

A maximal suppression of TTR protein of up to about 80% was achieved in all of the groups that received either 2.5 mg/kg, 5 mg/kg or 10 mg/kg of AD-51547. Nadir knockdown was achieved in all of the groups by about day 14, the suppression sustained at nadir knockdown levels with a weekly maintenance dose of either 2.5 mg/kg, 5 mg/kg or 10 mg/kg of AD-51547. The levels of TTR had not returned to baseline more than 40 days after the day of administration of the last maintenance dose for the 5 and 2.5 mg/kg dose levels.

EQUIVALENTS

Those skilled in the art will recognize, or be able to ascertain using no more than routine experimentation, many equivalents to the specific embodiments and methods described herein. Such equivalents are intended to be encompassed by the scope of the following claims.

SEQUENCE LISTING (2217 sequences)

SEQ ID NO: 1 - DNA, 614 bp, Homo sapiens
cagaagtccactcattcttggcaggatggcttctcatcgtctgctcctcctctgccttgctggactggtatttgtgtctgaggctggccctacgggcaccggtgaatccaagtgtcctctgatggtcaaagttctagatgctgtccgaggcagtcctgccatcaatgtggccgtgcatgtgttcagaaaggctgctgatgacacctgggagccatttgcctctgggaaaaccagtgagtctggagagctgcatgggctcacaactgaggaggaatttgtagaagggatatacaaagtggaaatagacaccaaatcttactggaaggcacttggcatctccccattccatgagcatgcagaggtggtattcacagccaacgactccggcccccgccgctacaccattgccgccctgctgagcccctactcctattccaccacggctgtcgtcaccaatcccaaggaatgagggacttctcctccagtggacctgaaggacgagggatgggatttcatgtaaccaagagtattccatttttactaaagcagtgttttcacctcatatgctatgttagaagtccaggcagagacaataaaacattcctgtgaaaggc

SEQ ID NO: 2 - RNA, 21 nt, Artificial Sequence
  Description of Artificial Sequence: Synthetic oligonucleotide
ugggauuucauguaaccaaga

SEQ ID NO: 3 - RNA, 23 nt, Artificial Sequence
  Description of Artificial Sequence: Synthetic oligonucleotide
ucuugguuacaugaaaucccauc

SEQ ID NO: 4 - protein, 16 aa, Unknown
  Description of Unknown: Exemplary hydrophobic membrane translocation peptide
AAVALLPAVLLALLAP

SEQ ID NO: 5 - protein, 11 aa, Unknown
  Description of Unknown: RFGF analogue peptide
AALLPVLLAAP

SEQ ID NO: 6 - protein, 13 aa, Human immunodeficiency virus
GRKKRRQRRRPPQ

SEQ ID NO: 7 - protein, 16 aa, Drosophila sp.
RQIKIWFQNRRMKWKK

SEQ ID NO: 8 - RNA, 21 nt, Artificial Sequence
  Description of Artificial Sequence: Synthetic oligonucleotide
aacaguguucuugcucuauaa

SEQ ID NO: 9 - RNA, 23 nt, Artificial Sequence
  Description of Artificial Sequence: Synthetic oligonucleotide
uuauagagcaagaacacuguuuu

SEQ ID NO: 10 - RNA, 21 nt, Artificial Sequence
  Description of Artificial Sequence: Synthetic oligonucleotide
aacaguguucuugcucuauaa

SEQ ID NO: 11 - RNA, 23 nt, Artificial Sequence
  Description of Artificial Sequence: Synthetic oligonucleotide
uuauagagcaagaacacuguuuu

SEQ ID NO: 12 - DNA, 21 bp, Artificial Sequence
  Description of Artificial Sequence: Synthetic oligonucleotide
  Description of Combined DNA/RNA Molecule: Synthetic oligonucleotide
guaaccaagaguauuccautt

SEQ ID NO: 13 - DNA, 21 bp, Artificial Sequence
  Description of Artificial Sequence: Synthetic oligonucleotide
  Description of Combined DNA/RNA Molecule: Synthetic oligonucleotide
auggaauacucuugguuactt

SEQ ID NO: 14 - RNA, 21 nt, Artificial Sequence
  Description of Artificial Sequence: Synthetic oligonucleotide
auguaaccaagaguauuccau

SEQ ID NO: 15 - RNA, 21 nt, Artificial Sequence
  Description of Artificial Sequence: Synthetic oligonucleotide
auguaaccaagaguauuccau

SEQ ID NO: 16 - RNA, 23 nt, Artificial Sequence
  Description of Artificial Sequence: Synthetic oligonucleotide
auggaauacucuugguuacauga

SEQ ID NO: 17 - RNA, 23 nt, Artificial Sequence
  Description of Artificial Sequence: Synthetic oligonucleotide
auggaauacucuugguuacauga

SEQ ID NO: 18 - RNA, 21 nt, Artificial Sequence
  Description of Artificial Sequence: Synthetic oligonucleotide
auguaaccaagaguauuccau

SEQ ID NO: 19 - RNA, 21 nt, Artificial Sequence
  Description of Artificial Sequence: Synthetic oligonucleotide
auguaaccaagaguauuccau

SEQ ID NO: 20 - RNA, 21 nt, Artificial Sequence
  Description of Artificial Sequence: Synthetic oligonucleotide
auguaaccaagaguauuccau

SEQ ID NO: 21 - RNA, 21 nt, Artificial Sequence
  Description of Artificial Sequence: Synthetic oligonucleotide
auguaaccaagaguauuccau

SEQ ID NO: 22 - RNA, 21 nt, Artificial Sequence
  Description of Artificial Sequence: Synthetic oligonucleotide
auguaacccagaguauuccau

SEQ ID NO: 23 - RNA, 21 nt, Artificial Sequence
  Description of Artificial Sequence: Synthetic oligonucleotide
auguaaccaagaguauuccau

SEQ ID NO: 24 - RNA, 21 nt, Artificial Sequence
  Description of Artificial Sequence: Synthetic oligonucleotide
auguaaccaagaguauuccau

SEQ ID NO: 25 - RNA, 21 nt, Artificial Sequence
  Description of Artificial Sequence: Synthetic oligonucleotide
auguaaccaagaguauuccau

SEQ ID NO: 26 - DNA, 21 bp, Artificial Sequence
  Description of Artificial Sequence: Synthetic oligonucleotide
  Description of Combined DNA/RNA Molecule: Synthetic oligonucleotide
auguaaccaagaguauacgau

SEQ ID NO: 27 - RNA, 21 nt, Artificial Sequence
  Description of Artificial Sequence: Synthetic oligonucleotide
ugggauuucauguaaccaaga

SEQ ID NO: 28 - RNA, 21 nt, Artificial Sequence
  Description of Artificial Sequence: Synthetic oligonucleotide
ugggauuucauguaaccaaga

SEQ ID NO: 29 - RNA, 21 nt, Artificial Sequence
  Description of Artificial Sequence: Synthetic oligonucleotide
auguaaccaagaguauuccau

SEQ ID NO: 30 - RNA, 21 nt, Artificial Sequence
  Description of Artificial Sequence: Synthetic oligonucleotide
ugggauuucauguaaccaaga

SEQ ID NO: 31 - DNA, 21 bp, Artificial Sequence
  Description of Artificial Sequence: Synthetic oligonucleotide
  Description of Combined DNA/RNA Molecule: Synthetic oligonucleotide
auguaaccaagaguauacgau

SEQ ID NO: 32 - RNA, 21 nt, Artificial Sequence
  Description of Artificial Sequence: Synthetic oligonucleotide
auguaaccaagaguauuccau

SEQ ID NO: 33 - DNA, 21 bp, Artificial Sequence
  Description of Artificial Sequence: Synthetic oligonucleotide
  Description of Combined DNA/RNA Molecule: Synthetic oligonucleotide
auguaaccaagagtatuccau

SEQ ID NO: 34 - RNA, 21 nt, Artificial Sequence
  Description of Artificial Sequence: Synthetic oligonucleotide
auguaaccaagaguauuccau

SEQ ID NO: 35 - RNA, 21 nt, Artificial Sequence
  Description of Artificial Sequence: Synthetic oligonucleotide
ugggauuucauguaaccaaga

SEQ ID NO: 36 - RNA, 21 nt, Artificial Sequence
  Description of Artificial Sequence: Synthetic oligonucleotide
auguaaccaagaguauuccau

SEQ ID NO: 37 - RNA, 21 nt, Artificial Sequence
  Description of Artificial Sequence: Synthetic oligonucleotide
auguaaccaagaguauuccau

SEQ ID NO: 38 - RNA, 21 nt, Artificial Sequence
  Description of Artificial Sequence: Synthetic oligonucleotide
auguaaccaagaguauuccau

SEQ ID NO: 39 - RNA, 21 nt, Artificial Sequence
  Description of Artificial Sequence: Synthetic oligonucleotide
auguaaccaagaguauuccau

SEQ ID NO: 40 - DNA, 21 bp, Artificial Sequence
  Description of Artificial Sequence: Synthetic oligonucleotide
  Description of Combined DNA/RNA Molecule: Synthetic oligonucleotide
tgggatuucaugtaaccaaga

SEQ ID NO: 41 - RNA, 21 nt, Artificial Sequence
  Description of Artificial Sequence: Synthetic oligonucleotide
auguaaccaagaguauuccau

SEQ ID NO: 42 - RNA, 21 nt, Artificial Sequence
  Description of Artificial Sequence: Synthetic oligonucleotide
ugggauuucauguaaccaaga

SEQ ID NO: 43 - RNA, 21 nt, Artificial Sequence
  Description of Artificial Sequence: Synthetic oligonucleotide
ugggauuucauguaaccaaga

SEQ ID NO: 44 - RNA, 21 nt, Artificial Sequence
  Description of Artificial Sequence: Synthetic oligonucleotide
ugggauuucauguaaccaaga

SEQ ID NO: 45 - RNA, 21 nt, Artificial Sequence
  Description of Artificial Sequence: Synthetic oligonucleotide
ugggauuucauguaaccaaga

SEQ ID NO: 46 - DNA, 21 bp, Artificial Sequence
  Description of Artificial Sequence: Synthetic oligonucleotide
  Description of Combined DNA/RNA Molecule: Synthetic oligonucleotide
atguaaccaagagtautccat

SEQ ID NO: 47 - DNA, 21 bp, Artificial Sequence
  Description of Artificial Sequence: Synthetic oligonucleotide
  Description of Combined DNA/RNA Molecule: Synthetic oligonucleotide
atgtaaccaagagtatuccau

SEQ ID NO: 48 - RNA, 21 nt, Artificial Sequence
  Description of Artificial Sequence: Synthetic oligonucleotide
ugggauuucauguaaccaaga

SEQ ID NO: 49 - RNA, 21 nt, Artificial Sequence
  Description of Artificial Sequence: Synthetic oligonucleotide
auguaaccaagaguauuccau

SEQ ID NO: 50 - RNA, 21 nt, Artificial Sequence
  Description of Artificial Sequence: Synthetic oligonucleotide
auguaaccaagaguauuccau

SEQ ID NO: 51 - RNA, 21 nt, Artificial Sequence
  Description of Artificial Sequence: Synthetic oligonucleotide
ugggauuucauguaaccaaga

SEQ ID NO: 52 - RNA, 21 nt, Artificial Sequence
  Description of Artificial Sequence: Synthetic oligonucleotide
auguaaccaagaguauuccau

SEQ ID NO: 53 - RNA, 21 nt, Artificial Sequence
  Description of Artificial Sequence: Synthetic oligonucleotide
ugggauuucauguaaccaaga

SEQ ID NO: 54 - RNA, 21 nt, Artificial Sequence
  Description of Artificial Sequence: Synthetic oligonucleotide
ugggauuucauguaaccaaga

SEQ ID NO: 55 - RNA, 21 nt, Artificial Sequence
  Description of Artificial Sequence: Synthetic oligonucleotide
ugggauuucauguaaccaaga

SEQ ID NO: 56 - RNA, 21 nt, Artificial Sequence
  Description of Artificial Sequence: Synthetic oligonucleotide
ugggauuucauguaaccaaga

SEQ ID NO: 57 - RNA, 21 nt, Artificial Sequence
  Description of Artificial Sequence: Synthetic oligonucleotide
auguaaccaagaguauuccau

SEQ ID NO: 58 - RNA, 21 nt, Artificial Sequence
  Description of Artificial Sequence: Synthetic oligonucleotide
auguaaccaagaguauuccau

SEQ ID NO: 59 - RNA, 21 nt, Artificial Sequence
  Description of Artificial Sequence: Synthetic oligonucleotide
auguaaccaagaguauuccau

SEQ ID NO: 60 - RNA, 21 nt, Artificial Sequence
  Description of Artificial Sequence: Synthetic oligonucleotide
ugggauuucauguaaccaaga

SEQ ID NO: 61 - RNA, 21 nt, Artificial Sequence
  Description of Artificial Sequence: Synthetic oligonucleotide
auguaaccaagaguauuccau

SEQ ID NO: 62 - RNA, 21 nt, Artificial Sequence
  Description of Artificial Sequence: Synthetic oligonucleotide
auguaaccaagaguauuccau

SEQ ID NO: 63 - RNA, 21 nt, Artificial Sequence
  Description of Artificial Sequence: Synthetic oligonucleotide
auguaaccaagaggauuccau

SEQ ID NO: 64 - RNA, 21 nt, Artificial Sequence
  Description of Artificial Sequence: Synthetic oligonucleotide
auguaaccaagaguauuccau

SEQ ID NO: 65 - RNA, 21 nt, Artificial Sequence
  Description of Artificial Sequence: Synthetic oligonucleotide
ugggauuucauguaaccaaga

SEQ ID NO: 66 - RNA, 21 nt, Artificial Sequence
  Description of Artificial Sequence: Synthetic oligonucleotide
auguaaccaagaguauuccau

SEQ ID NO: 67 - RNA, 21 nt, Artificial Sequence
  Description of Artificial Sequence: Synthetic oligonucleotide
auguaaccaagaguauuccau

SEQ ID NO: 68 - RNA, 21 nt, Artificial Sequence
  Description of Artificial Sequence: Synthetic oligonucleotide
ugggauuucauguaaccaaga

SEQ ID NO: 69 - RNA, 21 nt, Artificial Sequence
  Description of Artificial Sequence: Synthetic oligonucleotide
auguaaccaagaguauuccau

SEQ ID NO: 70 - DNA, 21 bp, Artificial Sequence
  Description of Artificial Sequence: Synthetic oligonucleotide
  Description of Combined DNA/RNA Molecule: Synthetic oligonucleotide
auguaaccaagagtatuccau

SEQ ID NO: 71 - DNA, 21 bp, Artificial Sequence
  Description of Artificial Sequence: Synthetic oligonucleotide
  Description of Combined DNA/RNA Molecule: Synthetic oligonucleotide
auguaaccaagagtatuccau

SEQ ID NO: 72 - DNA, 21 bp, Artificial Sequence
  Description of Artificial Sequence: Synthetic oligonucleotide
  Description of Combined DNA/RNA Molecule: Synthetic oligonucleotide
auguaaccaagagtauuccau

SEQ ID NO: 73 - DNA, 21 bp, Artificial Sequence
  Description of Artificial Sequence: Synthetic oligonucleotide
  Description of Combined DNA/RNA Molecule: Synthetic oligonucleotide
auguaaccaagagtatuccau

SEQ ID NO: 74 - RNA, 21 nt, Artificial Sequence
  Description of Artificial Sequence: Synthetic oligonucleotide
auguaaccaagaguauuccau

SEQ ID NO: 75 - RNA, 21 nt, Artificial Sequence
  Description of Artificial Sequence: Synthetic oligonucleotide
auguaaccaagaguauuccau

SEQ ID NO: 76 - RNA, 21 nt, Artificial Sequence
  Description of Artificial Sequence: Synthetic oligonucleotide
auguaaccaagaguauuccau

SEQ ID NO: 77 - DNA, 21 bp, Artificial Sequence
  Description of Artificial Sequence: Synthetic oligonucleotide
  Description of Combined DNA/RNA Molecule: Synthetic oligonucleotide
auguaaccaagagtatuccau

SEQ ID NO: 78 - DNA, 21 bp, Artificial Sequence
  Description of Artificial Sequence: Synthetic oligonucleotide
  Description of Combined DNA/RNA Molecule: Synthetic oligonucleotide
atguaaccaagagtatuccat

SEQ ID NO: 79 - DNA, 21 bp, Artificial Sequence
  Description of Artificial Sequence: Synthetic oligonucleotide
  Description of Combined DNA/RNA Molecule: Synthetic oligonucleotide
auguaaccaagaguauuccau

SEQ ID NO: 80 - DNA, 21 bp, Artificial Sequence
  Description of Artificial Sequence: Synthetic oligonucleotide
  Description of Combined DNA/RNA Molecule: Synthetic oligonucleotide
auguaaccaagagtatuccau

SEQ ID NO: 81 - DNA, 21 bp, Artificial Sequence
  Description of Artificial Sequence: Synthetic oligonucleotide
  Description of Combined DNA/RNA Molecule: Synthetic oligonucleotide
atguaacccagagtauuccau

SEQ ID NO: 82 - DNA, 21 bp, Artificial Sequence
  Description of Artificial Sequence: Synthetic oligonucleotide
  Description of Combined DNA/RNA Molecule: Synthetic oligonucleotide
auguaaccaagagtauuccau

SEQ ID NO: 83 - DNA, 21 bp, Artificial Sequence
  Description of Artificial Sequence: Synthetic oligonucleotide
  Description of Combined DNA/RNA Molecule: Synthetic oligonucleotide
auguaaccaagagtatuccau

SEQ ID NO: 84 - DNA, 21 bp, Artificial Sequence
  Description of Artificial Sequence: Synthetic oligonucleotide
  Description of Combined DNA/RNA Molecule: Synthetic oligonucleotide
auguaaccaagaguatuccau

SEQ ID NO: 85 - DNA, 21 bp, Artificial Sequence
  Description of Artificial Sequence: Synthetic oligonucleotide
  Description of Combined DNA/RNA Molecule: Synthetic oligonucleotide
auguaaccaagagtatuccau

SEQ ID NO: 86 - DNA, 21 bp, Artificial Sequence
  Description of Artificial Sequence: Synthetic oligonucleotide
  Description of Combined DNA/RNA Molecule: Synthetic oligonucleotide
auguaaccaagagtatuccau

SEQ ID NO: 87 - RNA, 21 nt, Artificial Sequence
  Description of Artificial Sequence: Synthetic oligonucleotide
auguaacccagaguauuccau

SEQ ID NO: 88 - RNA, 21 nt, Artificial Sequence
  Description of Artificial Sequence: Synthetic oligonucleotide
auguaaccaagaguauuccau

SEQ ID NO: 89 - RNA, 21 nt, Artificial Sequence
  Description of Artificial Sequence: Synthetic oligonucleotide
ugggauuucauguaaccaaga

SEQ ID NO: 90 - RNA, 21 nt, Artificial Sequence
  Description of Artificial Sequence: Synthetic oligonucleotide
auguaaccaagaguauuccau

SEQ ID NO: 91 - DNA, 21 bp, Artificial Sequence
  Description of Artificial Sequence: Synthetic oligonucleotide
  Description of Combined DNA/RNA Molecule: Synthetic oligonucleotide
auguaaccaagagtatuccau

SEQ ID NO: 92 - RNA, 21 nt, Artificial Sequence
  Description of Artificial Sequence: Synthetic oligonucleotide
auguaaccaagaguauuccau

SEQ ID NO: 93 - RNA, 21 nt, Artificial Sequence
  Description of Artificial Sequence: Synthetic oligonucleotide
auguaaccaagaguauuccau

SEQ ID NO: 94 - DNA, 21 bp, Artificial Sequence
  Description of Artificial Sequence: Synthetic oligonucleotide
  Description of Combined DNA/RNA Molecule: Synthetic oligonucleotide
auguaaccaagaguattccau

SEQ ID NO: 95 - RNA, 21 nt, Artificial Sequence
  Description of Artificial Sequence: Synthetic oligonucleotide
auguaaccaagaguauuccau

SEQ ID NO: 96 - RNA, 21 nt, Artificial Sequence
  Description of Artificial Sequence: Synthetic oligonucleotide
auguaaccaagaguauuccau

SEQ ID NO: 97 - DNA, 21 bp, Artificial Sequence
  Description of Artificial Sequence: Synthetic oligonucleotide
  Description of Combined DNA/RNA Molecule: Synthetic oligonucleotide
auguaaccaagagtatuccau

SEQ ID NO: 98 - RNA, 21 nt, Artificial Sequence
  Description of Artificial Sequence: Synthetic oligonucleotide
auguaaccaagaguauuccau

SEQ ID NO: 99 - DNA, 21 bp, Artificial Sequence
  Description of Artificial Sequence: Synthetic oligonucleotide
  Description of Combined DNA/RNA Molecule: Synthetic oligonucleotide
auguaaccaagaguauuccat

SEQ ID NO: 100 - RNA, 21 nt, Artificial Sequence
  Description of Artificial Sequence: Synthetic oligonucleotide
auguaaccaagaguauuccau

SEQ ID NO: 101 - RNA, 21 nt, Artificial Sequence
  Description of Artificial Sequence: Synthetic oligonucleotide
auguaaccaagaguauuccau

SEQ ID NO: 102 - RNA, 21 nt, Artificial Sequence
  Description of Artificial Sequence: Synthetic oligonucleotide
auguaaccaagaguauuccau

SEQ ID NO: 103 - RNA, 21 nt, Artificial Sequence
  Description of Artificial Sequence: Synthetic oligonucleotide
auguaaccaagaguauuccau

SEQ ID NO: 104 - RNA, 21 nt, Artificial Sequence
  Description of Artificial Sequence: Synthetic oligonucleotide
auguaaccaagaguauuccau

SEQ ID NO: 105 - RNA, 21 nt, Artificial Sequence
  Description of Artificial Sequence: Synthetic oligonucleotide
auguaaccaagaguauuccau

SEQ ID NO: 106 - RNA, 21 nt, Artificial Sequence
  Description of Artificial Sequence: Synthetic oligonucleotide
auguaaccaagaguauuccau

SEQ ID NO: 107 - RNA, 21 nt, Artificial Sequence
  Description of Artificial Sequence: Synthetic oligonucleotide
auguaaccaagaguauuccau

SEQ ID NO: 108 - RNA, 21 nt, Artificial Sequence
  Description of Artificial Sequence: Synthetic oligonucleotide
auguaaccaagaguauuccau

SEQ ID NO: 109 - DNA, 21 bp, Artificial Sequence
  Description of Artificial Sequence: Synthetic oligonucleotide
  Description of Combined DNA/RNA Molecule: Synthetic oligonucleotide
auguaaccaagagtatuccau

SEQ ID NO: 110 - RNA, 21 nt, Artificial Sequence
  Description of Artificial Sequence: Synthetic oligonucleotide
auguaaccaagaguauuccau

SEQ ID NO: 111 - RNA, 21 nt, Artificial Sequence
  Description of Artificial Sequence: Synthetic oligonucleotide
auguaaccaagaguauuccau

SEQ ID NO: 112 - RNA, 21 nt, Artificial Sequence
  Description of Artificial Sequence: Synthetic oligonucleotide
auguaaccaagaguauuccau

SEQ ID NO: 113 - RNA, 21 nt, Artificial Sequence
  Description of Artificial Sequence: Synthetic oligonucleotide
auguaaccaagaguauuccau

SEQ ID NO: 114 - RNA, 21 nt, Artificial Sequence
  Description of Artificial Sequence: Synthetic oligonucleotide
auguaaccaagaguauuccau

SEQ ID NO: 115 - RNA, 21 nt, Artificial Sequence
  Description of Artificial Sequence: Synthetic oligonucleotide
auguaaccaagaguauuccau

SEQ ID NO: 116 - RNA, 21 nt, Artificial Sequence
  Description of Artificial Sequence: Synthetic oligonucleotide
auguaaccaagaguauuccau

SEQ ID NO: 117 - RNA, 21 nt, Artificial Sequence
  Description of Artificial Sequence: Synthetic oligonucleotide
auguaaccaagaguauuccau

SEQ ID NO: 118 - RNA, 21 nt, Artificial Sequence
  Description of Artificial Sequence: Synthetic oligonucleotide
auguaaccaagaguauuccau

SEQ ID NO: 119 - RNA, 21 nt, Artificial Sequence
  Description of Artificial Sequence: Synthetic oligonucleotide
auguaaccaagaguauuccau

SEQ ID NO: 120 - RNA, 21 nt, Artificial Sequence
  Description of Artificial Sequence: Synthetic oligonucleotide
auguaaccaagaguauuccau

SEQ ID NO: 121 - RNA, 21 nt, Artificial Sequence
  Description of Artificial Sequence: Synthetic oligonucleotide
auguaaccaagaguauuccau

SEQ ID NO: 122 - RNA, 21 nt, Artificial Sequence
  Description of Artificial Sequence: Synthetic oligonucleotide
auguaaccaagaguauuccau

SEQ ID NO: 123 - RNA, 21 nt, Artificial Sequence
  Description of Artificial Sequence: Synthetic oligonucleotide
auguaaccaagaguauuccau

SEQ ID NO: 124 - RNA, 21 nt, Artificial Sequence
  Description of Artificial Sequence: Synthetic oligonucleotide
auguaaccaagaguauuccau

SEQ ID NO: 125 - RNA, 21 nt, Artificial Sequence
  Description of Artificial Sequence: Synthetic oligonucleotide
auguaaccaagaguauuccau

SEQ ID NO: 126 - DNA, 21 bp, Artificial Sequence
  Description of Artificial Sequence: Synthetic oligonucleotide
  Description of Combined DNA/RNA Molecule: Synthetic oligonucleotide
auguaaccaagagtatuccau

SEQ ID NO: 127 - RNA, 21 nt, Artificial Sequence
  Description of Artificial Sequence: Synthetic oligonucleotide
auguaaccaagaguauuccau

SEQ ID NO: 128 - RNA, 21 nt, Artificial Sequence
  Description of Artificial Sequence: Synthetic oligonucleotide
auguaaccaagaguauuccau

SEQ ID NO: 129 - RNA, 21 nt, Artificial Sequence
  Description of Artificial Sequence: Synthetic oligonucleotide
auguaaccaagaguauuccau

SEQ ID NO: 130 - RNA, 21 nt, Artificial Sequence
  Description of Artificial Sequence: Synthetic oligonucleotide
auguaaccaagaguauuccau

SEQ ID NO: 131 - RNA, 21 nt, Artificial Sequence
  Description of Artificial Sequence: Synthetic oligonucleotide
auguaaccaagaguauuccau

SEQ ID NO: 132 - RNA, 21 nt, Artificial Sequence
  Description of Artificial Sequence: Synthetic oligonucleotide
auguaaccaagaguauuccau

SEQ ID NO: 133 - RNA, 21 nt, Artificial Sequence
  Description of Artificial Sequence: Synthetic oligonucleotide
auguaaccaagaguauuccau

SEQ ID NO: 134 - RNA, 21 nt, Artificial Sequence
  Description of Artificial Sequence: Synthetic oligonucleotide
auguaaccaagaguauuccau

SEQ ID NO: 135 - RNA, 21 nt, Artificial Sequence
  Description of Artificial Sequence: Synthetic oligonucleotide
auguaaccaagaguauuccau

SEQ ID NO: 136 - RNA, 21 nt, Artificial Sequence
  Description of Artificial Sequence: Synthetic oligonucleotide
auguaaccaagaguauuccau

SEQ ID NO: 137 - RNA, 21 nt, Artificial Sequence
  Description of Artificial Sequence: Synthetic oligonucleotide
auguaaccaagaguauuccau

SEQ ID NO: 138 - RNA, 21 nt, Artificial Sequence
  Description of Artificial Sequence: Synthetic oligonucleotide
auguaaccaagaguauuccau

SEQ ID NO: 139 - RNA, 21 nt, Artificial Sequence
  Description of Artificial Sequence: Synthetic oligonucleotide
auguaaccaagaguauuccau

SEQ ID NO: 140 - RNA, 21 nt, Artificial Sequence
  Description of Artificial Sequence: Synthetic oligonucleotide
auguaaccaagaguauuccau

SEQ ID NO: 141 - RNA, 21 nt, Artificial Sequence
  Description of Artificial Sequence: Synthetic oligonucleotide
auguaaccaagaguauuccau

SEQ ID NO: 142 - RNA, 21 nt, Artificial Sequence
  Description of Artificial Sequence: Synthetic oligonucleotide
auguaaccaagaguauuccau

SEQ ID NO: 143 - RNA, 21 nt, Artificial Sequence
  Description of Artificial Sequence: Synthetic oligonucleotide
auguaaccaagaguauuccau

SEQ ID NO: 144 - RNA, 21 nt, Artificial Sequence
  Description of Artificial Sequence: Synthetic oligonucleotide
auguaaccaagaguauuccau

SEQ ID NO: 145 - RNA, 21 nt, Artificial Sequence
  Description of Artificial Sequence: Synthetic oligonucleotide
auguaaccaagaguauuccau

SEQ ID NO: 146 - RNA, 21 nt, Artificial Sequence
  Description of Artificial Sequence: Synthetic oligonucleotide
auguaaccaagaguauuccau

SEQ ID NO: 147 - RNA, 21 nt, Artificial Sequence
  Description of Artificial Sequence: Synthetic oligonucleotide
auguaaccaagaguauuccau

SEQ ID NO: 148 - RNA, 21 nt, Artificial Sequence
  Description of Artificial Sequence: Synthetic oligonucleotide
auguaaccaagaguauuccau

SEQ ID NO: 149 - RNA, 21 nt, Artificial Sequence
  Description of Artificial Sequence: Synthetic oligonucleotide
auguaaccaagaguauuccau

SEQ ID NO: 150 - RNA, 21 nt, Artificial Sequence
  Description of Artificial Sequence: Synthetic oligonucleotide
auguaaccaagaguauuccau

SEQ ID NO: 151 - RNA, 21 nt, Artificial Sequence
  Description of Artificial Sequence: Synthetic oligonucleotide
auguaaccaagaguauuccau

SEQ ID NO: 152 - RNA, 21 nt, Artificial Sequence
  Description of Artificial Sequence: Synthetic oligonucleotide
auguaaccaagaguauuccau

SEQ ID NO: 153 - RNA, 21 nt, Artificial Sequence
  Description of Artificial Sequence: Synthetic oligonucleotide
auguaaccaagaguauuccau

SEQ ID NO: 154 - RNA, 21 nt, Artificial Sequence
  Description of Artificial Sequence: Synthetic oligonucleotide
auguaaccaagaguauuccau

SEQ ID NO: 155 - RNA, 21 nt, Artificial Sequence
  Description of Artificial Sequence: Synthetic oligonucleotide
auguaaccaagaguauuccau

SEQ ID NO: 156 - RNA, 21 nt, Artificial Sequence
  Description of Artificial Sequence: Synthetic oligonucleotide
auguaaccaagaguauuccau

SEQ ID NO: 157 - RNA, 21 nt, Artificial Sequence
  Description of Artificial Sequence: Synthetic oligonucleotide
auguaaccaagaguauuccau

SEQ ID NO: 158 - RNA, 21 nt, Artificial Sequence
  Description of Artificial Sequence: Synthetic oligonucleotide
auguaaccaagaguauuccau

SEQ ID NO: 159 - RNA, 21 nt, Artificial Sequence
  Description of Artificial Sequence: Synthetic oligonucleotide
auguaaccaagaguauuccau

SEQ ID NO: 160 - RNA, 21 nt, Artificial Sequence
  Description of Artificial Sequence: Synthetic oligonucleotide
auguaaccaagaguauuccau

SEQ ID NO: 161 - RNA, 21 nt, Artificial Sequence
  Description of Artificial Sequence: Synthetic oligonucleotide
auguaaccaagaguauuccau

SEQ ID NO: 162 - RNA, 21 nt, Artificial Sequence
  Description of Artificial Sequence: Synthetic oligonucleotide
auguaaccaagaguauuccau

SEQ ID NO: 163 - RNA, 21 nt, Artificial Sequence
  Description of Artificial Sequence: Synthetic oligonucleotide
auguaaccaagaguauuccau

SEQ ID NO: 164 - RNA, 21 nt, Artificial Sequence
  Description of Artificial Sequence: Synthetic oligonucleotide
auguaaccaagaguauuccau

SEQ ID NO: 165 - RNA, 21 nt, Artificial Sequence
  Description of Artificial Sequence: Synthetic oligonucleotide
auguaaccaagaguauuccau

SEQ ID NO: 166 - RNA, 21 nt, Artificial Sequence
  Description of Artificial Sequence: Synthetic oligonucleotide
auguaaccaagaguauuccau

SEQ ID NO: 167 - RNA, 21 nt, Artificial Sequence
  Description of Artificial Sequence: Synthetic oligonucleotide
auguaaccaagaguauuccau

SEQ ID NO: 168 - RNA, 21 nt, Artificial Sequence
  Description of Artificial Sequence: Synthetic oligonucleotide
auguaaccaagaguauuccau

SEQ ID NO: 169 - RNA, 21 nt, Artificial Sequence
  Description of Artificial Sequence: Synthetic oligonucleotide
auguaaccaagaguauuccau

SEQ ID NO: 170 - RNA, 21 nt, Artificial Sequence
  Description of Artificial Sequence: Synthetic oligonucleotide
auguaaccaagaguauuccau

SEQ ID NO: 171 - RNA, 21 nt, Artificial Sequence
  Description of Artificial Sequence: Synthetic oligonucleotide
auguaaccaagaguauuccau

SEQ ID NO: 172 - RNA, 21 nt, Artificial Sequence
  Description of Artificial Sequence: Synthetic oligonucleotide
ugggauuucauguaaccaaga

SEQ ID NO: 173 - RNA, 21 nt, Artificial Sequence
  Description of Artificial Sequence: Synthetic oligonucleotide
ugggauuucauguaaccaaga

SEQ ID NO: 174 - RNA, 21 nt, Artificial Sequence
  Description of Artificial Sequence: Synthetic oligonucleotide
ugggauuucauguaaccaaga

SEQ ID NO: 175 - RNA, 21 nt, Artificial Sequence
  Description of Artificial Sequence: Synthetic oligonucleotide
ugggauuucauguaaccaaga

SEQ ID NO: 176 - RNA, 21 nt, Artificial Sequence
  Description of Artificial Sequence: Synthetic oligonucleotide
ugggauuucauguaaccaaga

SEQ ID NO: 177 - RNA, 21 nt, Artificial Sequence
  Description of Artificial Sequence: Synthetic oligonucleotide
ugggauuucauguaaccaaga

SEQ ID NO: 178 - RNA, 21 nt, Artificial Sequence
  Description of Artificial Sequence: Synthetic oligonucleotide
ugggauuucauguaaccaaga

SEQ ID NO: 179 - RNA, 21 nt, Artificial Sequence
  Description of Artificial Sequence: Synthetic oligonucleotide
ugggauuucauguaaccaaga

SEQ ID NO: 180 - RNA, 21 nt, Artificial Sequence
  Description of Artificial Sequence: Synthetic oligonucleotide
auguaaccaagaguauuccau

SEQ ID NO: 181 - RNA, 21 nt, Artificial Sequence
  Description of Artificial Sequence: Synthetic oligonucleotide
auguaaccaagaguauuccau

SEQ ID NO: 182 - RNA, 21 nt, Artificial Sequence
  Description of Artificial Sequence: Synthetic oligonucleotide
auguaaccaagaguauuccau

SEQ ID NO: 183 - RNA, 21 nt, Artificial Sequence
  Description of Artificial Sequence: Synthetic oligonucleotide
auguaaccaagaguauuccau

SEQ ID NO: 184 - RNA, 21 nt, Artificial Sequence
  Description of Artificial Sequence: Synthetic oligonucleotide
auguaaccaagaguauuccau

SEQ ID NO: 185 - RNA, 21 nt, Artificial Sequence
  Description of Artificial Sequence: Synthetic oligonucleotide
auguaaccaagaguauuccau

SEQ ID NO: 186 - RNA, 21 nt, Artificial Sequence
  Description of Artificial Sequence: Synthetic oligonucleotide
auguaaccaagaguauuccau

SEQ ID NO: 187 - RNA, 21 nt, Artificial Sequence
  Description of Artificial Sequence: Synthetic oligonucleotide
auguaaccaagaguauuccau

SEQ ID NO: 188 - RNA, 21 nt, Artificial Sequence
  Description of Artificial Sequence: Synthetic oligonucleotide
auguaaccaagaguauuccau

SEQ ID NO: 189 - RNA, 21 nt, Artificial Sequence
  Description of Artificial Sequence: Synthetic oligonucleotide
auguaaccaagaguauuccau

SEQ ID NO: 190 - RNA, 21 nt, Artificial Sequence
  Description of Artificial Sequence: Synthetic oligonucleotide
auguaaccaagaguauuccau

SEQ ID NO: 191 - RNA, 21 nt, Artificial Sequence
  Description of Artificial Sequence: Synthetic oligonucleotide
auguaaccaagaguauuccau

SEQ ID NO: 192 - RNA, 21 nt, Artificial Sequence
  Description of Artificial Sequence: Synthetic oligonucleotide
auguaaccaagaguauuccau

SEQ ID NO: 193 - RNA, 21 nt, Artificial Sequence
  Description of Artificial Sequence: Synthetic oligonucleotide
auguaaccaagaguauuccau

SEQ ID NO: 194 - RNA, 21 nt, Artificial Sequence
  Description of Artificial Sequence: Synthetic oligonucleotide
auguaaccaagaguauuccau

SEQ ID NO: 195 - RNA, 21 nt, Artificial Sequence
  Description of Artificial Sequence: Synthetic oligonucleotide
auguaaccaagaguauuccau

SEQ ID NO: 196 - RNA, 21 nt, Artificial Sequence
  Description of Artificial Sequence: Synthetic oligonucleotide
auguaaccaagaguauuccau

SEQ ID NO: 197 - RNA, 21 nt, Artificial Sequence
  Description of Artificial Sequence: Synthetic oligonucleotide
auguaaccaagaguauuccau

SEQ ID NO: 198 - RNA, 21 nt, Artificial Sequence
  Description of Artificial Sequence: Synthetic oligonucleotide
auguaaccaagaguauuccau

SEQ ID NO: 199 - RNA, 21 nt, Artificial Sequence
  Description of Artificial Sequence: Synthetic oligonucleotide
auguaaccaagaguauuccau

SEQ ID NO: 200 - RNA, 21 nt, Artificial Sequence
  Description of Artificial Sequence: Synthetic oligonucleotide
auguaaccaagaguauuccau

SEQ ID NO: 201 - RNA, 21 nt, Artificial Sequence
  Description of Artificial Sequence: Synthetic oligonucleotide
auguaaccaagaguauuccau

SEQ ID NO: 202 - RNA, 21 nt, Artificial Sequence
  Description of Artificial Sequence: Synthetic oligonucleotide
auguaaccaagaguauuccau

SEQ ID NO: 203 - RNA, 21 nt, Artificial Sequence
  Description of Artificial Sequence: Synthetic oligonucleotide
auguaaccaagaguauuccau

SEQ ID NO: 204 - RNA, 21 nt, Artificial Sequence
  Description of Artificial Sequence: Synthetic oligonucleotide
auguaaccaagaguauuccau

SEQ ID NO: 205 - RNA, 21 nt, Artificial Sequence
  Description of Artificial Sequence: Synthetic oligonucleotide
auguaaccaagaguauuccau

SEQ ID NO: 206 - RNA, 21 nt, Artificial Sequence
  Description of Artificial Sequence: Synthetic oligonucleotide
auguaaccaagaguauuccau

SEQ ID NO: 207 - RNA, 21 nt, Artificial Sequence
  Description of Artificial Sequence: Synthetic oligonucleotide
auguaaccaagaguauuccau

SEQ ID NO: 208 - RNA, 21 nt, Artificial Sequence
  Description of Artificial Sequence: Synthetic oligonucleotide
auguaaccaagaguauuccau

SEQ ID NO: 209 - RNA, 21 nt, Artificial Sequence
  Description of Artificial Sequence: Synthetic oligonucleotide
auguaaccaagaguauuccau

SEQ ID NO: 210 - RNA, 21 nt, Artificial Sequence
  Description of Artificial Sequence: Synthetic oligonucleotide
auguaaccaagaguauuccau

SEQ ID NO: 211 - RNA, 21 nt, Artificial Sequence
  Description of Artificial Sequence: Synthetic oligonucleotide
auguaaccaagaguauuccau

SEQ ID NO: 212 - RNA, 21 nt, Artificial Sequence
  Description of Artificial Sequence: Synthetic oligonucleotide
auguaaccaagaguauuccau

SEQ ID NO: 213 - RNA, 21 nt, Artificial Sequence
  Description of Artificial Sequence: Synthetic oligonucleotide
auguaaccaagaguauuccau

SEQ ID NO: 214 - RNA, 21 nt, Artificial Sequence
  Description of Artificial Sequence: Synthetic oligonucleotide
auguaaccaagaguauuccau

SEQ ID NO: 215 - RNA, 21 nt, Artificial Sequence
  Description of Artificial Sequence: Synthetic oligonucleotide
auguaaccaagaguauuccau

SEQ ID NO: 216 - RNA, 21 nt, Artificial Sequence
  Description of Artificial Sequence: Synthetic oligonucleotide
auguaaccaagaguauuccau

SEQ ID NO: 217 - RNA, 21 nt, Artificial Sequence
  Description of Artificial Sequence: Synthetic oligonucleotide
auguaaccaagaguauuccau

SEQ ID NO: 218 - RNA, 21 nt, Artificial Sequence
  Description of Artificial Sequence: Synthetic oligonucleotide
auguaaccaagaguauuccau

SEQ ID NO: 219 - RNA, 21 nt, Artificial Sequence
  Description of Artificial Sequence: Synthetic oligonucleotide
auguaaccaagaguauuccau

SEQ ID NO: 220 - RNA, 21 nt, Artificial Sequence
  Description of Artificial Sequence: Synthetic oligonucleotide
auguaaccaagaguauuccau

SEQ ID NO: 221 - RNA, 21 nt, Artificial Sequence
  Description of Artificial Sequence: Synthetic oligonucleotide
auguaaccaagaguauuccau

SEQ ID NO: 222 - RNA, 21 nt, Artificial Sequence
  Description of Artificial Sequence: Synthetic oligonucleotide
auguaaccaagaguauuccau

SEQ ID NO: 223 - DNA, 21 bp, Artificial Sequence
  Description of Artificial Sequence: Synthetic oligonucleotide
  Description of Combined DNA/RNA Molecule: Synthetic oligonucleotide
auguaaccaagagtattccau

SEQ ID NO: 224 - RNA, 21 nt, Artificial Sequence
  Description of Artificial Sequence: Synthetic oligonucleotide
auguaaccaagaguauuccau

SEQ ID NO: 225 - RNA, 21 nt, Artificial Sequence
  Description of Artificial Sequence: Synthetic oligonucleotide
auguaaccaagaguauuccau

SEQ ID NO: 226 - RNA, 21 nt, Artificial Sequence
  Description of Artificial Sequence: Synthetic oligonucleotide
auguaaccaagaguauuccau

SEQ ID NO: 227 - RNA, 21 nt, Artificial Sequence
  Description of Artificial Sequence: Synthetic oligonucleotide
auguaaccaagaguauuccau

SEQ ID NO: 228 - RNA, 21 nt, Artificial Sequence
  Description of Artificial Sequence: Synthetic oligonucleotide
auguaaccaagaguauuccau

SEQ ID NO: 229 - RNA, 21 nt, Artificial Sequence
  Description of Artificial Sequence: Synthetic oligonucleotide
auguaaccaagaguauuccau

SEQ ID NO: 230 - RNA, 21 nt, Artificial Sequence
  Description of Artificial Sequence: Synthetic oligonucleotide
auguaaccaagaguauuccau

SEQ ID NO: 231 - DNA, 21 bp, Artificial Sequence
  Description of Artificial Sequence: Synthetic oligonucleotide
  Description of Combined DNA/RNA Molecule: Synthetic oligonucleotide
auguaaccaagaguautccau

SEQ ID NO: 232 - RNA, 21 nt, Artificial Sequence
  Description of Artificial Sequence: Synthetic oligonucleotide
auguaaccaagaguauuccau

SEQ ID NO: 233 - DNA, 21 bp, Artificial Sequence
  Description of Artificial Sequence: Synthetic oligonucleotide
  Description of Combined DNA/RNA Molecule: Synthetic oligonucleotide
auguaaccaagaguattccau

SEQ ID NO: 234 - RNA, 21 nt, Artificial Sequence
  Description of Artificial Sequence: Synthetic oligonucleotide
auguaaccaagaguauuccau

SEQ ID NO: 235 - RNA, 21 nt, Artificial Sequence
  Description of Artificial Sequence: Synthetic oligonucleotide
auguaaccaagaguauuccau

SEQ ID NO: 236 - RNA, 21 nt, Artificial Sequence
  Description of Artificial Sequence: Synthetic oligonucleotide
auguaaccaagaguauuccau

SEQ ID NO: 237 - RNA, 21 nt, Artificial Sequence
  Description of Artificial Sequence: Synthetic oligonucleotide
auguaaccaagaguauuccau

SEQ ID NO: 238 - RNA, 21 nt, Artificial Sequence
  Description of Artificial Sequence: Synthetic oligonucleotide
auguaaccaagaguauuccau

SEQ ID NO: 239 - RNA, 21 nt, Artificial Sequence
  Description of Artificial Sequence: Synthetic oligonucleotide
auguaaccaagaguauuccau

SEQ ID NO: 240 - RNA, 21 nt, Artificial Sequence
  Description of Artificial Sequence: Synthetic oligonucleotide
auguaaccaagaguauuccau

SEQ ID NO: 241 - RNA, 21 nt, Artificial Sequence
  Description of Artificial Sequence: Synthetic oligonucleotide
auguaaccaagaguauuccau

SEQ ID NO: 242 - RNA, 21 nt, Artificial Sequence
  Description of Artificial Sequence: Synthetic oligonucleotide
auguaaccaagaguauuccau

SEQ ID NO: 243 - RNA, 21 nt, Artificial Sequence
  Description of Artificial Sequence: Synthetic oligonucleotide
auguaaccaagaguauuccau

SEQ ID NO: 244 - RNA, 21 nt, Artificial Sequence
  Description of Artificial Sequence: Synthetic oligonucleotide
auguaaccaagaguauuccau

SEQ ID NO: 245 - RNA, 21 nt, Artificial Sequence
  Description of Artificial Sequence: Synthetic oligonucleotide
auguaaccaagaguauuccau

SEQ ID NO: 246 - RNA, 21 nt, Artificial Sequence
  Description of Artificial Sequence: Synthetic oligonucleotide
auguaaccaagaguauuccau

SEQ ID NO: 247 - RNA, 21 nt, Artificial Sequence
  Description of Artificial Sequence: Synthetic oligonucleotide
auguaaccaagaguauuccau

SEQ ID NO: 248 - RNA, 21 nt, Artificial Sequence
  Description of Artificial Sequence: Synthetic oligonucleotide
auguaaccaagaguauuccau

SEQ ID NO: 249 - RNA, 21 nt, Artificial Sequence
  Description of Artificial Sequence: Synthetic oligonucleotide
auguaaccaagaguauuccau

SEQ ID NO: 250 - RNA, 21 nt, Artificial Sequence
  Description of Artificial Sequence: Synthetic oligonucleotide
auguaaccaagaguauuccau

SEQ ID NO: 251 - RNA, 21 nt, Artificial Sequence
  Description of Artificial Sequence: Synthetic oligonucleotide
auguaaccaagaguauuccau

SEQ ID NO: 252 - RNA, 21 nt, Artificial Sequence
  Description of Artificial Sequence: Synthetic oligonucleotide
auguaaccaagaguauuccau

SEQ ID NO: 253 - RNA, 21 nt, Artificial Sequence
  Description of Artificial Sequence: Synthetic oligonucleotide
auguaaccaagaguauuccau

SEQ ID NO: 254 - RNA, 21 nt, Artificial Sequence
  Description of Artificial Sequence: Synthetic oligonucleotide
auguaaccaagaguauuccau

SEQ ID NO: 255 - RNA, 21 nt, Artificial Sequence
  Description of Artificial Sequence: Synthetic oligonucleotide
auguaaccaagaguauuccau

SEQ ID NO: 256 - RNA, 21 nt, Artificial Sequence
  Description of Artificial Sequence: Synthetic oligonucleotide
auguaaccaagaguauuccau

SEQ ID NO: 257 - RNA, 21 nt, Artificial Sequence
  Description of Artificial Sequence: Synthetic oligonucleotide
auguaaccaagaguauuccau

SEQ ID NO: 258 - RNA, 21 nt, Artificial Sequence
  Description of Artificial Sequence: Synthetic oligonucleotide
auguaaccaagaguauuccau

SEQ ID NO: 259 - RNA, 21 nt, Artificial Sequence
  Description of Artificial Sequence: Synthetic oligonucleotide
auguaaccaagaguauuccau

SEQ ID NO: 260 - RNA, 21 nt, Artificial Sequence
  Description of Artificial Sequence: Synthetic oligonucleotide
auguaaccaagaguauuccau

SEQ ID NO: 261 - RNA, 21 nt, Artificial Sequence
  Description of Artificial Sequence: Synthetic oligonucleotide
auguaaccaagaguauuccau

SEQ ID NO: 262 - RNA, 21 nt, Artificial Sequence
  Description of Artificial Sequence: Synthetic oligonucleotide
auguaaccaagaguauuccau

SEQ ID NO: 263 - RNA, 21 nt, Artificial Sequence
  Description of Artificial Sequence: Synthetic oligonucleotide
auguaaccaagaguauuccau

SEQ ID NO: 264 - RNA, 21 nt, Artificial Sequence
  Description of Artificial Sequence: Synthetic oligonucleotide
auguaaccaagaguauuccau

SEQ ID NO: 265 - RNA, 21 nt, Artificial Sequence
  Description of Artificial Sequence: Synthetic oligonucleotide
auguaaccaagaguauuccau

SEQ ID NO: 266 - DNA, 21 bp, Artificial Sequence
  Description of Artificial Sequence: Synthetic oligonucleotide
  Description of Combined DNA/RNA Molecule: Synthetic oligonucleotide
aacaauguucuugcucuauaa

SEQ ID NO: 267 - RNA, 21 nt, Artificial Sequence
  Description of Artificial Sequence: Synthetic oligonucleotide
aacaguguucuugcucuauaa

SEQ ID NO: 268 - RNA, 21 nt, Artificial Sequence
  Description of Artificial Sequence: Synthetic oligonucleotide
aacaguguucuugcucuauaa

SEQ ID NO: 269 - RNA, 21 nt, Artificial Sequence
  Description of Artificial Sequence: Synthetic oligonucleotide
aacaguguucuugcucuauaa

SEQ ID NO: 270 - DNA, 21 bp, Artificial Sequence
  Description of Artificial Sequence: Synthetic oligonucleotide
  Description of Combined DNA/RNA Molecule: Synthetic oligonucleotide
caguguucuugcucuauaatt

SEQ ID NO: 271 - RNA, 21 nt, Artificial Sequence
  Description of Artificial Sequence: Synthetic oligonucleotide
aacaguguucuugcucuauaa

SEQ ID NO: 272 - RNA, 21 nt, Artificial Sequence
  Description of Artificial Sequence: Synthetic oligonucleotide
aacaguguucuugcucuauaa

SEQ ID NO: 273 - RNA, 21 nt, Artificial Sequence
  Description of Artificial Sequence: Synthetic oligonucleotide
aacaguguucuugcucuauaa

SEQ ID NO: 274 - RNA, 21 nt, Artificial Sequence
  Description of Artificial Sequence: Synthetic oligonucleotide
aacaguguucuugcucuauaa

SEQ ID NO: 275 - RNA, 21 nt, Artificial Sequence
  Description of Artificial Sequence: Synthetic oligonucleotide
aacaguguucuugcucuauaa

SEQ ID NO: 276 - RNA, 21 nt, Artificial Sequence
  Description of Artificial Sequence: Synthetic oligonucleotide
aacaguguucuugcucuauaa

SEQ ID NO: 277 - RNA, 21 nt, Artificial Sequence
  Description of Artificial Sequence: Synthetic oligonucleotide
aacaguguucuugcucuauaa

SEQ ID NO: 278 - RNA, 21 nt, Artificial Sequence
  Description of Artificial Sequence: Synthetic oligonucleotide
aacaguguucuugcucuauaa

SEQ ID NO: 279 - RNA, 21 nt, Artificial Sequence
  Description of Artificial Sequence: Synthetic oligonucleotide
aacaguguucuugcucuauaa

SEQ ID NO: 280 - RNA, 21 nt, Artificial Sequence
  Description of Artificial Sequence: Synthetic oligonucleotide
aacaguguucuugcucuauaa

SEQ ID NO: 281 - DNA, 21 bp, Artificial Sequence
  Description of Artificial Sequence: Synthetic oligonucleotide
  Description of Combined DNA/RNA Molecule: Synthetic oligonucleotide
caguguucuugcucuauaatt

SEQ ID NO: 282 - RNA, 21 nt, Artificial Sequence
  Description of Artificial Sequence: Synthetic oligonucleotide
aacaguguucuugcucuauaa

SEQ ID NO: 283 - RNA, 21 nt, Artificial Sequence
  Description of Artificial Sequence: Synthetic oligonucleotide
aacaguguucuugcucuauaa

SEQ ID NO: 284 - RNA, 21 nt, Artificial Sequence
  Description of Artificial Sequence: Synthetic oligonucleotide
aacaguguucuugcucuauaa

SEQ ID NO: 285 - DNA, 21 bp, Artificial Sequence
  Description of Artificial Sequence: Synthetic oligonucleotide
  Description of Combined DNA/RNA Molecule: Synthetic oligonucleotide
aacaauguucuugcucuauaa

SEQ ID NO: 286 - RNA, 21 nt, Artificial Sequence
  Description of Artificial Sequence: Synthetic oligonucleotide
aacaguguucuugcucuauaa

SEQ ID NO: 287 - DNA, 21 bp, Artificial Sequence
  Description of Artificial Sequence: Synthetic oligonucleotide
  Description of Combined DNA/RNA Molecule: Synthetic oligonucleotide
caguguucuugcucuauaatt

SEQ ID NO: 288 - RNA, 21 nt, Artificial Sequence
  Description of Artificial Sequence: Synthetic oligonucleotide
aacaguguucuugcucuauaa

SEQ ID NO: 289 - RNA, 21 nt, Artificial Sequence
  Description of Artificial Sequence: Synthetic oligonucleotide
aacaguguucuugcucuauaa

SEQ ID NO: 290 - DNA, 21 bp, Artificial Sequence
  Description of Artificial Sequence: Synthetic oligonucleotide
  Description of Combined DNA/RNA Molecule: Synthetic oligonucleotide
caguguucuugcucuauaatt

SEQ ID NO: 291 - RNA, 21 nt, Artificial Sequence
  Description of Artificial Sequence: Synthetic oligonucleotide
aacaguguucuugcucuauaa

SEQ ID NO: 292 - RNA, 21 nt, Artificial Sequence
  Description of Artificial Sequence: Synthetic oligonucleotide
aacaguguucuugcucuauaa

SEQ ID NO: 293 - DNA, 21 bp, Artificial Sequence
  Description of Artificial Sequence: Synthetic oligonucleotide
  Description of Combined DNA/RNA Molecule: Synthetic oligonucleotide
caguguucuugcucuauaatt

SEQ ID NO: 294 - RNA, 21 nt, Artificial Sequence
  Description of Artificial Sequence: Synthetic oligonucleotide
aacaguguucuugcucuauaa

SEQ ID NO: 295 - RNA, 21 nt, Artificial Sequence
  Description of Artificial Sequence: Synthetic oligonucleotide
aacaguguucuugcucuauaa

SEQ ID NO: 296 - RNA, 21 nt, Artificial Sequence
  Description of Artificial Sequence: Synthetic oligonucleotide
aacaguguucuugcucuauaa

SEQ ID NO: 297 - DNA, 21 bp, Artificial Sequence
  Description of Artificial Sequence: Synthetic oligonucleotide
  Description of Combined DNA/RNA Molecule: Synthetic oligonucleotide
caguguucuugcucuauaatt

SEQ ID NO: 298 - RNA, 21 nt, Artificial Sequence
  Description of Artificial Sequence: Synthetic oligonucleotide
aacaguguucuugcucuauaa

SEQ ID NO: 299 - RNA, 21 nt, Artificial Sequence
  Description of Artificial Sequence: Synthetic oligonucleotide
aacaguguucuugcucuauaa

SEQ ID NO: 300 - RNA, 21 nt, Artificial Sequence
  Description of Artificial Sequence: Synthetic oligonucleotide
aacaguguucuugcucuauaa

SEQ ID NO: 301 - RNA, 21 nt, Artificial Sequence
  Description of Artificial Sequence: Synthetic oligonucleotide
aacaguguucuugcucuauaa

SEQ ID NO: 302 - RNA, 21 nt, Artificial Sequence
  Description of Artificial Sequence: Synthetic oligonucleotide
aacaguguucuugcucuauaa

SEQ ID NO: 303 - RNA, 21 nt, Artificial Sequence
  Description of Artificial Sequence: Synthetic oligonucleotide
aacaguguucuugcucuauaa

SEQ ID NO: 304 - RNA, 21 nt, Artificial Sequence
  Description of Artificial Sequence: Synthetic oligonucleotide
aacaguguucuugcucuauaa

SEQ ID NO: 305 - RNA, 21 nt, Artificial Sequence
  Description of Artificial Sequence: Synthetic oligonucleotide
aacaguguucuugcucuauaa

SEQ ID NO: 306 - RNA, 21 nt, Artificial Sequence
  Description of Artificial Sequence: Synthetic oligonucleotide
aacaguguucuugcucuauaa

SEQ ID NO: 307 - RNA, 21 nt, Artificial Sequence
  Description of Artificial Sequence: Synthetic oligonucleotide
aacaguguucuugcucuauaa

SEQ ID NO: 308 - RNA, 21 nt, Artificial Sequence
  Description of Artificial Sequence: Synthetic oligonucleotide
aacaguguucuugcucuauaa

SEQ ID NO: 309 - RNA, 21 nt, Artificial Sequence
  Description of Artificial Sequence: Synthetic oligonucleotide
aacaguguucuugcucuauaa

SEQ ID NO: 310 - RNA, 21 nt, Artificial Sequence
  Description of Artificial Sequence: Synthetic oligonucleotide
aacaguguucuugcucuauaa

SEQ ID NO: 311 - RNA, 21 nt, Artificial Sequence
  Description of Artificial Sequence: Synthetic oligonucleotide
aacaguguucuugcucuauaa

SEQ ID NO: 312 - RNA, 21 nt, Artificial Sequence
  Description of Artificial Sequence: Synthetic oligonucleotide
aacaguguucuugcucuauaa

SEQ ID NO: 313 - RNA, 21 nt, Artificial Sequence
  Description of Artificial Sequence: Synthetic oligonucleotide
aacaguguucuugcucuauaa

SEQ ID NO: 314 - DNA, 21 bp, Artificial Sequence
  Description of Artificial Sequence: Synthetic oligonucleotide
  Description of Combined DNA/RNA Molecule: Synthetic oligonucleotide
aacagtguuctugctcuataa

SEQ ID NO: 315 - RNA, 21 nt, Artificial Sequence
  Description of Artificial Sequence: Synthetic oligonucleotide
aacaguguucuugcucuauaa

SEQ ID NO: 316 - RNA, 21 nt, Artificial Sequence
  Description of Artificial Sequence: Synthetic oligonucleotide
aacaguguucuugcucuauaa

SEQ ID NO: 317 - RNA, 21 nt, Artificial Sequence
  Description of Artificial Sequence: Synthetic oligonucleotide
aacaguguucuugcucuauaa

SEQ ID NO: 318 - RNA, 21 nt, Artificial Sequence
  Description of Artificial Sequence: Synthetic oligonucleotide
aacaguguucuugcucuauaa

SEQ ID NO: 319 - RNA, 21 nt, Artificial Sequence
  Description of Artificial Sequence: Synthetic oligonucleotide
aacaguguucuugcucuauaa

SEQ ID NO: 320 - RNA, 21 nt, Artificial Sequence
  Description of Artificial Sequence: Synthetic oligonucleotide
aacaguguucuugcucuauaa

SEQ ID NO: 321 - RNA, 21 nt, Artificial Sequence
  Description of Artificial Sequence: Synthetic oligonucleotide
aacaguguucuugcucuauaa

SEQ ID NO: 322 - RNA, 21 nt, Artificial Sequence
  Description of Artificial Sequence: Synthetic oligonucleotide
aacaguguucuugcucuauaa

SEQ ID NO: 323 - DNA, 21 bp, Artificial Sequence
  Description of Artificial Sequence: Synthetic oligonucleotide
  Description of Combined DNA/RNA Molecule: Synthetic oligonucleotide
aacagugtucttgctcuataa

SEQ ID NO: 324 - DNA, 21 bp, Artificial Sequence
  Description of Artificial Sequence: Synthetic oligonucleotide
  Description of Combined DNA/RNA Molecule: Synthetic oligonucleotide
aacaguguucuugcucuauaa

SEQ ID NO: 325 - DNA, 21 bp, Artificial Sequence
  Description of Artificial Sequence: Synthetic oligonucleotide
  Description of Combined DNA/RNA Molecule: Synthetic oligonucleotide
aacaguguucutgcucuauaa

SEQ ID NO: 326 - DNA, 21 bp, Artificial Sequence
  Description of Artificial Sequence: Synthetic oligonucleotide
  Description of Combined DNA/RNA Molecule: Synthetic oligonucleotide
aacaguguucuugcucuauaa

SEQ ID NO: 327 - DNA, 21 bp, Artificial Sequence
  Description of Artificial Sequence: Synthetic oligonucleotide
  Description of Combined DNA/RNA Molecule: Synthetic oligonucleotide
aacaguguucutgcucuauaa

SEQ ID NO: 328 - DNA, 21 bp, Artificial Sequence
  Description of Artificial Sequence: Synthetic oligonucleotide
  Description of Combined DNA/RNA Molecule: Synthetic oligonucleotide
aacaauguucutgcucuauaa

SEQ ID NO: 329 - DNA, 21 bp, Artificial Sequence
  Description of Artificial Sequence: Synthetic oligonucleotide
  Description of Combined DNA/RNA Molecule: Synthetic oligonucleotide
aacaauguucuugcucuataa

SEQ ID NO: 330 - DNA, 21 bp, Artificial Sequence
  Description of Artificial Sequence: Synthetic oligonucleotide
  Description of Combined DNA/RNA Molecule: Synthetic oligonucleotide
aacaguguucuugcucuauaa

SEQ ID NO: 331 - RNA, 21 nt, Artificial Sequence
  Description of Artificial Sequence: Synthetic oligonucleotide
aacaguguucuugcucuauaa

SEQ ID NO: 332 - RNA, 21 nt, Artificial Sequence
  Description of Artificial Sequence: Synthetic oligonucleotide
aacaguguucuugcucuauaa

SEQ ID NO: 333 - RNA, 21 nt, Artificial Sequence
  Description of Artificial Sequence: Synthetic oligonucleotide
aacaguguucuugcucuauaa

SEQ ID NO: 334 - RNA, 21 nt, Artificial Sequence
  Description of Artificial Sequence: Synthetic oligonucleotide
aacaguguucuugcucuauaa

SEQ ID NO: 335 - RNA, 21 nt, Artificial Sequence
  Description of Artificial Sequence: Synthetic oligonucleotide
aacaguguucuugcucuauaa

SEQ ID NO: 336 - RNA, 21 nt, Artificial Sequence
  Description of Artificial Sequence: Synthetic oligonucleotide
aacaguguucuugcucuauaa

SEQ ID NO: 337 - RNA, 21 nt, Artificial Sequence
  Description of Artificial Sequence: Synthetic oligonucleotide
aacaguguucuugcucuauaa

SEQ ID NO: 338 - RNA, 21 nt, Artificial Sequence
  Description of Artificial Sequence: Synthetic oligonucleotide
aacaguguucuugcucuauaa

SEQ ID NO: 339 - RNA, 21 nt, Artificial Sequence
  Description of Artificial Sequence: Synthetic oligonucleotide
aacaguguucuugcucuauaa

SEQ ID NO: 340 - RNA, 21 nt, Artificial Sequence
  Description of Artificial Sequence: Synthetic oligonucleotide
aacaguguucuugcucuauaa

SEQ ID NO: 341 - RNA, 21 nt, Artificial Sequence
  Description of Artificial Sequence: Synthetic oligonucleotide
aacaguguucuugcucuauaa

SEQ ID NO: 342 - RNA, 21 nt, Artificial Sequence
  Description of Artificial Sequence: Synthetic oligonucleotide
aacaguguucuugcucuauaa

SEQ ID NO: 343 - RNA, 21 nt, Artificial Sequence
  Description of Artificial Sequence: Synthetic oligonucleotide
aacaguguucuugcucuauaa

SEQ ID NO: 344 - RNA, 21 nt, Artificial Sequence
  Description of Artificial Sequence: Synthetic oligonucleotide
aacaguguucuugcucuauaa

SEQ ID NO: 345 - RNA, 21 nt, Artificial Sequence
  Description of Artificial Sequence: Synthetic oligonucleotide
aacaguguucuugcucuauaa

SEQ ID NO: 346 - RNA, 21 nt, Artificial Sequence
  Description of Artificial Sequence: Synthetic oligonucleotide
aacaguguucuugcucuauaa

SEQ ID NO: 347 - RNA, 21 nt, Artificial Sequence
  Description of Artificial Sequence: Synthetic oligonucleotide
aacaguguucuugcucuauaa

SEQ ID NO: 348 - RNA, 21 nt, Artificial Sequence
  Description of Artificial Sequence: Synthetic oligonucleotide
aacaguguucuugcucuauaa

SEQ ID NO: 349 - RNA, 21 nt, Artificial Sequence
  Description of Artificial Sequence: Synthetic oligonucleotide
aacaguguucuugcucuauaa

SEQ ID NO: 350 - RNA, 21 nt, Artificial Sequence
  Description of Artificial Sequence: Synthetic oligonucleotide
aacaguguucuugcucuauaa

SEQ ID NO: 351 - RNA, 21 nt, Artificial Sequence
  Description of Artificial Sequence: Synthetic oligonucleotide
aacaguguucuugcucuauaa

SEQ ID NO: 352 - RNA, 21 nt, Artificial Sequence
  Description of Artificial Sequence: Synthetic oligonucleotide
aacaguguucuugcucuauaa

SEQ ID NO: 353 - RNA, 21 nt, Artificial Sequence
  Description of Artificial Sequence: Synthetic oligonucleotide
aacaguguucuugcucuauaa

SEQ ID NO: 354 - RNA, 21 nt, Artificial Sequence
  Description of Artificial Sequence: Synthetic oligonucleotide
aacaguguucuugcucuauaa

SEQ ID NO: 355 - RNA, 21 nt, Artificial Sequence
  Description of Artificial Sequence: Synthetic oligonucleotide
aacaguguucuugcucuauaa

SEQ ID NO: 356 - RNA, 21 nt, Artificial Sequence
  Description of Artificial Sequence: Synthetic oligonucleotide
aacaguguucuugcucuauaa

SEQ ID NO: 357 - RNA, 21 nt, Artificial Sequence
  Description of Artificial Sequence: Synthetic oligonucleotide
aacaguguucuugcucuauaa

SEQ ID NO: 358 - RNA, 21 nt, Artificial Sequence
  Description of Artificial Sequence: Synthetic oligonucleotide
aacaguguucuugcucuauaa

SEQ ID NO: 359 - RNA, 21 nt, Artificial Sequence
  Description of Artificial Sequence: Synthetic oligonucleotide
aacaguguucuugcucuauaa

SEQ ID NO: 360 - RNA, 21 nt, Artificial Sequence
  Description of Artificial Sequence: Synthetic oligonucleotide
aacaguguucuugcucuauaa

SEQ ID NO: 361 - RNA, 21 nt, Artificial Sequence
  Description of Artificial Sequence: Synthetic oligonucleotide
aacaguguucuugcucuauaa

SEQ ID NO: 362 - RNA, 21 nt, Artificial Sequence
  Description of Artificial Sequence: Synthetic oligonucleotide
aacaguguucuugcucuauaa

SEQ ID NO: 363 - RNA, 21 nt, Artificial Sequence
  Description of Artificial Sequence: Synthetic oligonucleotide
aacaguguucuugcucuauaa

SEQ ID NO: 364 - RNA, 21 nt, Artificial Sequence
  Description of Artificial Sequence: Synthetic oligonucleotide
aacaguguucuugcucuauaa

SEQ ID NO: 365 - RNA, 21 nt, Artificial Sequence
  Description of Artificial Sequence: Synthetic oligonucleotide
aacaguguucuugcucuauaa

SEQ ID NO: 366 - RNA, 21 nt, Artificial Sequence
  Description of Artificial Sequence: Synthetic oligonucleotide
aacaguguucuugcucuauaa

SEQ ID NO: 367 - RNA, 21 nt, Artificial Sequence
  Description of Artificial Sequence: Synthetic oligonucleotide
aacaguguucuugcucuauaa

SEQ ID NO: 368 - RNA, 21 nt, Artificial Sequence
  Description of Artificial Sequence: Synthetic oligonucleotide
aacaguguucuugcucuauaa

SEQ ID NO: 369 - RNA, 21 nt, Artificial Sequence
  Description of Artificial Sequence: Synthetic oligonucleotide
aacaguguucuugcucuauaa

SEQ ID NO: 370 - RNA, 21 nt, Artificial Sequence
  Description of Artificial Sequence: Synthetic oligonucleotide
aacaguguucuugcucuauaa

SEQ ID NO: 371 - RNA, 21 nt, Artificial Sequence
  Description of Artificial Sequence: Synthetic oligonucleotide
aacaguguucuugcucuauaa

SEQ ID NO: 372 - RNA, 21 nt, Artificial Sequence
  Description of Artificial Sequence: Synthetic oligonucleotide
aacaguguucuugcucuauaa

SEQ ID NO: 373 - RNA, 21 nt, Artificial Sequence
  Description of Artificial Sequence: Synthetic oligonucleotide
aacaguguucuugcucuauaa

SEQ ID NO: 374 - RNA, 21 nt, Artificial Sequence
  Description of Artificial Sequence: Synthetic oligonucleotide
aacaguguucuugcucuauaa

SEQ ID NO: 375 - RNA, 21 nt, Artificial Sequence
  Description of Artificial Sequence: Synthetic oligonucleotide
aacaguguucuugcucuauaa

SEQ ID NO: 376 - RNA, 21 nt, Artificial Sequence
  Description of Artificial Sequence: Synthetic oligonucleotide
aacaguguucuugcucuauaa

SEQ ID NO: 377 - RNA, 21 nt, Artificial Sequence
  Description of Artificial Sequence: Synthetic oligonucleotide
aacaguguucuugcucuauaa

SEQ ID NO: 378 - RNA, 21 nt, Artificial Sequence
  Description of Artificial Sequence: Synthetic oligonucleotide
aacaguguucuugcucuauaa

SEQ ID NO: 379 - RNA, 21 nt, Artificial Sequence
  Description of Artificial Sequence: Synthetic oligonucleotide
aacaguguucuugcucuauaa

SEQ ID NO: 380 - RNA, 21 nt, Artificial Sequence
  Description of Artificial Sequence: Synthetic oligonucleotide
aacaguguucuugcucuauaa

SEQ ID NO: 381 - RNA, 21 nt, Artificial Sequence
  Description of Artificial Sequence: Synthetic oligonucleotide
aacaguguucuugcucuauaa

SEQ ID NO: 382 - RNA, 21 nt, Artificial Sequence
  Description of Artificial Sequence: Synthetic oligonucleotide
aacaguguucuugcucuauaa

SEQ ID NO: 383 - RNA, 21 nt, Artificial Sequence
  Description of Artificial Sequence: Synthetic oligonucleotide
aacaguguucuugcucuauaa

SEQ ID NO: 384 - RNA, 21 nt, Artificial Sequence
  Description of Artificial Sequence: Synthetic oligonucleotide
aacaguguucuugcucuauaa

SEQ ID NO: 385 - RNA, 21 nt, Artificial Sequence
  Description of Artificial Sequence: Synthetic oligonucleotide
aacaguguucuugcucuauaa

SEQ ID NO: 386 - RNA, 21 nt, Artificial Sequence
  Description of Artificial Sequence: Synthetic oligonucleotide
aacaguguucuugcucuauaa

SEQ ID NO: 387 - RNA, 21 nt, Artificial Sequence
  Description of Artificial Sequence: Synthetic oligonucleotide
aacaguguucuugcucuauaa

SEQ ID NO: 388 - RNA, 21 nt, Artificial Sequence
  Description of Artificial Sequence: Synthetic oligonucleotide
aacaguguucuugcucuauaa

SEQ ID NO: 389 - RNA, 21 nt, Artificial Sequence
  Description of Artificial Sequence: Synthetic oligonucleotide
aacaguguucuugcucuauaa

SEQ ID NO: 390 - RNA, 21 nt, Artificial Sequence
  Description of Artificial Sequence: Synthetic oligonucleotide
aacaguguucuugcucuauaa

SEQ ID NO: 391 - RNA, 21 nt, Artificial Sequence
  Description of Artificial Sequence: Synthetic oligonucleotide
aacaguguucuugcucuauaa

SEQ ID NO: 392 - RNA, 21 nt, Artificial Sequence
  Description of Artificial Sequence: Synthetic oligonucleotide
aacaguguucuugcucuauaa

SEQ ID NO: 393 - RNA, 21 nt, Artificial Sequence
  Description of Artificial Sequence: Synthetic oligonucleotide
aacaguguucuugcucuauaa

SEQ ID NO: 394 - RNA, 21 nt, Artificial Sequence
  Description of Artificial Sequence: Synthetic oligonucleotide
aacaguguucuugcucuauaa

SEQ ID NO: 395 - RNA, 21 nt, Artificial Sequence
  Description of Artificial Sequence: Synthetic oligonucleotide
aacaguguucuugcucuauaa

SEQ ID NO: 396 - RNA, 21 nt, Artificial Sequence
  Description of Artificial Sequence: Synthetic oligonucleotide
aacaguguucuugcucuauaa

SEQ ID NO: 397 - RNA, 21 nt, Artificial Sequence
  Description of Artificial Sequence: Synthetic oligonucleotide
aacaguguucuugcucuauaa

SEQ ID NO: 398 - RNA, 21 nt, Artificial Sequence
  Description of Artificial Sequence: Synthetic oligonucleotide
aacaguguucuugcucuauaa

SEQ ID NO: 399 - RNA, 21 nt, Artificial Sequence
  Description of Artificial Sequence: Synthetic oligonucleotide
aacaguguucuugcucuauaa

SEQ ID NO: 400 - RNA, 21 nt, Artificial Sequence
  Description of Artificial Sequence: Synthetic oligonucleotide
aacaguguucuugcucuauaa

SEQ ID NO: 401 - RNA, 21 nt, Artificial Sequence
  Description of Artificial Sequence: Synthetic oligonucleotide
aacaguguucuugcucuauaa

SEQ ID NO: 402 - RNA, 21 nt, Artificial Sequence
  Description of Artificial Sequence: Synthetic oligonucleotide
aacaguguucuugcucuauaa

SEQ ID NO: 403 - RNA, 21 nt, Artificial Sequence
  Description of Artificial Sequence: Synthetic oligonucleotide
aacaguguucuugcucuauaa

SEQ ID NO: 404 - DNA, 21 bp, Artificial Sequence
  Description of Artificial Sequence: Synthetic oligonucleotide
  Description of Combined DNA/RNA Molecule: Synthetic oligonucleotide
aacaguguucuugcucuauaa

SEQ ID NO: 405 - RNA, 21 nt, Artificial Sequence
  Description of Artificial Sequence: Synthetic oligonucleotide
aacaguguucuugcucuauaa

SEQ ID NO: 406 - RNA, 21 nt, Artificial Sequence
  Description of Artificial Sequence: Synthetic oligonucleotide
aacaguguucuugcucuauaa

SEQ ID NO: 407 - RNA, 21 nt, Artificial Sequence
  Description of Artificial Sequence: Synthetic oligonucleotide
aacaguguucuugcucuauaa

SEQ ID NO: 408 - RNA, 21 nt, Artificial Sequence
  Description of Artificial Sequence: Synthetic oligonucleotide
aacaguguucuugcucuauaa

SEQ ID NO: 409 - DNA, 21 bp, Artificial Sequence
  Description of Artificial Sequence: Synthetic oligonucleotide
  Description of Combined DNA/RNA Molecule: Synthetic oligonucleotide
aacaguguuctugctctataa

SEQ ID NO: 410 - RNA, 21 nt, Artificial Sequence
  Description of Artificial Sequence: Synthetic oligonucleotide
aacaguguucuugcucuauaa

SEQ ID NO: 411 - RNA, 21 nt, Artificial Sequence
  Description of Artificial Sequence: Synthetic oligonucleotide
aacaguguucuugcucuauaa

SEQ ID NO: 412 - RNA, 21 nt, Artificial Sequence
  Description of Artificial Sequence: Synthetic oligonucleotide
aacaguguucuugcucuauaa

SEQ ID NO: 413 - RNA, 21 nt, Artificial Sequence
  Description of Artificial Sequence: Synthetic oligonucleotide
aacaguguucuugcucuauaa

SEQ ID NO: 414 - RNA, 21 nt, Artificial Sequence
  Description of Artificial Sequence: Synthetic oligonucleotide
aacaguguucuugcucuauaa

SEQ ID NO: 415 - DNA, 21 bp, Artificial Sequence
  Description of Artificial Sequence: Synthetic oligonucleotide
  Description of Combined DNA/RNA Molecule: Synthetic oligonucleotide
aacaauguucuugcactauaa

SEQ ID NO: 416 - RNA, 21 nt, Artificial Sequence
  Description of Artificial Sequence: Synthetic oligonucleotide
aacaguguucuugcucuauaa

SEQ ID NO: 417 - DNA, 21 bp, Artificial Sequence
  Description of Artificial Sequence: Synthetic oligonucleotide
  Description of Combined DNA/RNA Molecule: Synthetic oligonucleotide
aacagugutcuugcuctauaa

SEQ ID NO: 418 - DNA, 21 bp, Artificial Sequence
  Description of Artificial Sequence: Synthetic oligonucleotide
  Description of Combined DNA/RNA Molecule: Synthetic oligonucleotide
aacaauguucuugcactauaa

SEQ ID NO: 419 - DNA, 21 bp, Artificial Sequence
  Description of Artificial Sequence: Synthetic oligonucleotide
  Description of Combined DNA/RNA Molecule: Synthetic oligonucleotide
aacaauguucuugcacuauaa

SEQ ID NO: 420 - RNA, 21 nt, Artificial Sequence
  Description of Artificial Sequence: Synthetic oligonucleotide
aacaguguucuugcucuauaa

SEQ ID NO: 421 - DNA, 21 bp, Artificial Sequence
  Description of Artificial Sequence: Synthetic oligonucleotide
  Description of Combined DNA/RNA Molecule: Synthetic oligonucleotide
aacaauguucuugcacuataa

SEQ ID NO: 422 - RNA, 21 nt, Artificial Sequence
  Description of Artificial Sequence: Synthetic oligonucleotide
aacaguguucuugcucuauaa

SEQ ID NO: 423 - RNA, 21 nt, Artificial Sequence
  Description of Artificial Sequence: Synthetic oligonucleotide
aacaguguucuugcucuauaa

SEQ ID NO: 424 - DNA, 21 bp, Artificial Sequence
  Description of Artificial Sequence: Synthetic oligonucleotide
  Description of Combined DNA/RNA Molecule: Synthetic oligonucleotide
aacaauguucuugcacuataa

SEQ ID NO: 425 - RNA, 21 nt, Artificial Sequence
  Description of Artificial Sequence: Synthetic oligonucleotide
aacaguguucuugcucuauaa

SEQ ID NO: 426 - DNA, 21 bp, Artificial Sequence
  Description of Artificial Sequence: Synthetic oligonucleotide
  Description of Combined DNA/RNA Molecule: Synthetic oligonucleotide
aacaauguucuugcactataa

SEQ ID NO: 427 - RNA, 21 nt, Artificial Sequence
  Description of Artificial Sequence: Synthetic oligonucleotide
aacaguguucuugcucuauaa

SEQ ID NO: 428 - DNA, 21 bp, Artificial Sequence
  Description of Artificial Sequence: Synthetic oligonucleotide
  Description of Combined DNA/RNA Molecule: Synthetic oligonucleotide
aacaauguucuugcactataa

SEQ ID NO: 429 - RNA, 21 nt, Artificial Sequence
  Description of Artificial Sequence: Synthetic oligonucleotide
aacaguguucuugcucuauaa

SEQ ID NO: 430 - DNA, 21 bp, Artificial Sequence
  Description of Artificial Sequence: Synthetic oligonucleotide
  Description of Combined DNA/RNA Molecule: Synthetic oligonucleotide
aacagugtucutgcucuauaa

SEQ ID NO: 431 - RNA, 21 nt, Artificial Sequence
  Description of Artificial Sequence: Synthetic oligonucleotide
aacaguguucuugcucuauaa

SEQ ID NO: 432 - RNA, 21 nt, Artificial Sequence
  Description of Artificial Sequence: Synthetic oligonucleotide
aacaguguucuugcucuauaa

SEQ ID NO: 433 - RNA, 21 nt, Artificial Sequence
  Description of Artificial Sequence: Synthetic oligonucleotide
aacaguguucuugcucuauaa

SEQ ID NO: 434 - RNA, 21 nt, Artificial Sequence
  Description of Artificial Sequence: Synthetic oligonucleotide
aacaguguucuugcucuauaa

SEQ ID NO: 435 - RNA, 21 nt, Artificial Sequence
  Description of Artificial Sequence: Synthetic oligonucleotide
aacaguguucuugcucuauaa

SEQ ID NO: 436 - RNA, 21 nt, Artificial Sequence
  Description of Artificial Sequence: Synthetic oligonucleotide
aacaguguucuugcucuauaa

SEQ ID NO: 437 - RNA, 21 nt, Artificial Sequence
  Description of Artificial Sequence: Synthetic oligonucleotide
aacaguguucuugcucuauaa

SEQ ID NO: 438 - RNA, 21 nt, Artificial Sequence
  Description of Artificial Sequence: Synthetic oligonucleotide
gacuucuccuccaguggaccu

SEQ ID NO: 439 - RNA, 21 nt, Artificial Sequence
  Description of Artificial Sequence: Synthetic oligonucleotide
gacuucuccuccaguggaccu

SEQ ID NO: 440 - RNA, 21 nt, Artificial Sequence
  Description of Artificial Sequence: Synthetic oligonucleotide
acuucuccuccaguggaccug

SEQ ID NO: 441 - RNA, 21 nt, Artificial Sequence
  Description of Artificial Sequence: Synthetic oligonucleotide
acuucuccuccaguggaccug

SEQ ID NO: 442 - RNA, 21 nt, Artificial Sequence
  Description of Artificial Sequence: Synthetic oligonucleotide
cuucuccuccaguggaccuga

SEQ ID NO: 443 - RNA, 21 nt, Artificial Sequence
  Description of Artificial Sequence: Synthetic oligonucleotide
cuucuccuccaguggaccuga

SEQ ID NO: 444 - RNA, 21 nt, Artificial Sequence
  Description of Artificial Sequence: Synthetic oligonucleotide
uucuccuccaguggaccugaa

SEQ ID NO: 445 - RNA, 21 nt, Artificial Sequence
  Description of Artificial Sequence: Synthetic oligonucleotide
uucuccuccaguggaccugaa

SEQ ID NO: 446 - RNA, 21 nt, Artificial Sequence
  Description of Artificial Sequence: Synthetic oligonucleotide
ucuccuccaguggaccugaag

SEQ ID NO: 447 - RNA, 21 nt, Artificial Sequence
  Description of Artificial Sequence: Synthetic oligonucleotide
ucuccuccaguggaccugaag

SEQ ID NO: 448 - RNA, 21 nt, Artificial Sequence
  Description of Artificial Sequence: Synthetic oligonucleotide
cuccuccaguggaccugaagg

SEQ ID NO: 449 - RNA, 21 nt, Artificial Sequence
  Description of Artificial Sequence: Synthetic oligonucleotide
cuccuccaguggaccugaagg

SEQ ID NO: 450 - RNA, 21 nt, Artificial Sequence
  Description of Artificial Sequence: Synthetic oligonucleotide
uccuccaguggaccugaagga

SEQ ID NO: 451 - RNA, 21 nt, Artificial Sequence
  Description of Artificial Sequence: Synthetic oligonucleotide
uccuccaguggaccugaagga

SEQ ID NO: 452 - RNA, 21 nt, Artificial Sequence
  Description of Artificial Sequence: Synthetic oligonucleotide
ccuccaguggaccugaaggac

SEQ ID NO: 453 - RNA, 21 nt, Artificial Sequence
  Description of Artificial Sequence: Synthetic oligonucleotide
ccuccaguggaccugaaggac

SEQ ID NO: 454 - RNA, 21 nt, Artificial Sequence
  Description of Artificial Sequence: Synthetic oligonucleotide
cuccaguggaccugaaggacg

SEQ ID NO: 455 - RNA, 21 nt, Artificial Sequence
  Description of Artificial Sequence: Synthetic oligonucleotide
cuccaguggaccugaaggacg

SEQ ID NO: 456 - RNA, 21 nt, Artificial Sequence
  Description of Artificial Sequence: Synthetic oligonucleotide
uccaguggaccugaaggacga

SEQ ID NO: 457 - RNA, 21 nt, Artificial Sequence
  Description of Artificial Sequence: Synthetic oligonucleotide
uccaguggaccugaaggacga

SEQ ID NO: 458 - RNA, 21 nt, Artificial Sequence
  Description of Artificial Sequence: Synthetic oligonucleotide
ccaguggaccugaaggacgag

SEQ ID NO: 459 - RNA, 21 nt, Artificial Sequence
  Description of Artificial Sequence: Synthetic oligonucleotide
ccaguggaccugaaggacgag

SEQ ID NO: 460 - RNA, 21 nt, Artificial Sequence
  Description of Artificial Sequence: Synthetic oligonucleotide
caguggaccugaaggacgagg

SEQ ID NO: 461 - RNA, 21 nt, Artificial Sequence
  Description of Artificial Sequence: Synthetic oligonucleotide
caguggaccugaaggacgagg

SEQ ID NO: 462 - RNA, 21 nt, Artificial Sequence
  Description of Artificial Sequence: Synthetic oligonucleotide
aguggaccugaaggacgaggg

SEQ ID NO: 463 - RNA, 21 nt, Artificial Sequence
  Description of Artificial Sequence: Synthetic oligonucleotide
aguggaccugaaggacgaggg

SEQ ID NO: 464 - RNA, 21 nt, Artificial Sequence
  Description of Artificial Sequence: Synthetic oligonucleotide
guggaccugaaggacgaggga

SEQ ID NO: 465 - RNA, 21 nt, Artificial Sequence
  Description of Artificial Sequence: Synthetic oligonucleotide
guggaccugaaggacgaggga

SEQ ID NO: 466 - RNA, 21 nt, Artificial Sequence
  Description of Artificial Sequence: Synthetic oligonucleotide
uggaccugaaggacgagggau

SEQ ID NO: 467 - RNA, 21 nt, Artificial Sequence
  Description of Artificial Sequence: Synthetic oligonucleotide
uggaccugaaggacgagggau

SEQ ID NO: 468 - RNA, 21 nt, Artificial Sequence
  Description of Artificial Sequence: Synthetic oligonucleotide
ggaccugaaggacgagggaug

SEQ ID NO: 469 - RNA, 21 nt, Artificial Sequence
  Description of Artificial Sequence: Synthetic oligonucleotide
ggaccugaaggacgagggaug

SEQ ID NO: 470 - RNA, 21 nt, Artificial Sequence
  Description of Artificial Sequence: Synthetic oligonucleotide
gaccugaaggacgagggaugg

SEQ ID NO: 471 - RNA, 21 nt, Artificial Sequence
  Description of Artificial Sequence: Synthetic oligonucleotide
gaccugaaggacgagggaugg

SEQ ID NO: 472 - RNA, 21 nt, Artificial Sequence
  Description of Artificial Sequence: Synthetic oligonucleotide
accugaaggacgagggauggg

SEQ ID NO: 473 - RNA, 21 nt, Artificial Sequence
  Description of Artificial Sequence: Synthetic oligonucleotide
accugaaggacgagggauggg

SEQ ID NO: 474 - RNA, 21 nt, Artificial Sequence
  Description of Artificial Sequence: Synthetic oligonucleotide
ccugaaggacgagggauggga

SEQ ID NO: 475 - RNA, 21 nt, Artificial Sequence
  Description of Artificial Sequence: Synthetic oligonucleotide
ccugaaggacgagggauggga

SEQ ID NO: 476 - RNA, 21 nt, Artificial Sequence
  Description of Artificial Sequence: Synthetic oligonucleotide
cugaaggacgagggaugggau

SEQ ID NO: 477 - RNA, 21 nt, Artificial Sequence
  Description of Artificial Sequence: Synthetic oligonucleotide
cugaaggacgagggaugggau

SEQ ID NO: 478 - RNA, 21 nt, Artificial Sequence
  Description of Artificial Sequence: Synthetic oligonucleotide
ugaaggacgagggaugggauu

SEQ ID NO: 479 - RNA, 21 nt, Artificial Sequence
  Description of Artificial Sequence: Synthetic oligonucleotide
ugaaggacgagggaugggauu

SEQ ID NO: 480 - RNA, 21 nt, Artificial Sequence
  Description of Artificial Sequence: Synthetic oligonucleotide
gaaggacgagggaugggauuu

SEQ ID NO: 481 - RNA, 21 nt, Artificial Sequence
  Description of Artificial Sequence: Synthetic oligonucleotide
gaaggacgagggaugggauuu

SEQ ID NO: 482 - RNA, 21 nt, Artificial Sequence
  Description of Artificial Sequence: Synthetic oligonucleotide
aaggacgagggaugggauuuc

SEQ ID NO: 483 - RNA, 21 nt, Artificial Sequence
  Description of Artificial Sequence: Synthetic oligonucleotide
aaggacgagggaugggauuuc

SEQ ID NO: 484 - RNA, 21 nt, Artificial Sequence
  Description of Artificial Sequence: Synthetic oligonucleotide
aggacgagggaugggauuuca

SEQ ID NO: 485 - RNA, 21 nt, Artificial Sequence
  Description of Artificial Sequence: Synthetic oligonucleotide
aggacgagggaugggauuuca

SEQ ID NO: 486 - RNA, 21 nt, Artificial Sequence
  Description of Artificial Sequence: Synthetic oligonucleotide
ggacgagggaugggauuucau

SEQ ID NO: 487 - RNA, 21 nt, Artificial Sequence
  Description of Artificial Sequence: Synthetic oligonucleotide
ggacgagggaugggauuucau

SEQ ID NO: 488 - RNA, 21 nt, Artificial Sequence
  Description of Artificial Sequence: Synthetic oligonucleotide
gacgagggaugggauuucaug

SEQ ID NO: 489 - RNA, 21 nt, Artificial Sequence
  Description of Artificial Sequence: Synthetic oligonucleotide
gacgagggaugggauuucaug

SEQ ID NO: 490 - RNA, 21 nt, Artificial Sequence
  Description of Artificial Sequence: Synthetic oligonucleotide
acgagggaugggauuucaugu

SEQ ID NO: 491 - RNA, 21 nt, Artificial Sequence
  Description of Artificial Sequence: Synthetic oligonucleotide
acgagggaugggauuucaugu

SEQ ID NO: 492 - RNA, 21 nt, Artificial Sequence
  Description of Artificial Sequence: Synthetic oligonucleotide
cgagggaugggauuucaugua

SEQ ID NO: 493 - RNA, 21 nt, Artificial Sequence
  Description of Artificial Sequence: Synthetic oligonucleotide
cgagggaugggauuucaugua

SEQ ID NO: 494 - RNA, 21 nt, Artificial Sequence
  Description of Artificial Sequence: Synthetic oligonucleotide
gagggaugggauuucauguaa

SEQ ID NO: 495 - RNA, 21 nt, Artificial Sequence
  Description of Artificial Sequence: Synthetic oligonucleotide
gagggaugggauuucauguaa

SEQ ID NO: 496 - RNA, 21 nt, Artificial Sequence
  Description of Artificial Sequence: Synthetic oligonucleotide
agggaugggauuucauguaac

SEQ ID NO: 497 - RNA, 21 nt, Artificial Sequence
  Description of Artificial Sequence: Synthetic oligonucleotide
agggaugggauuucauguaac

SEQ ID NO: 498 - RNA, 21 nt, Artificial Sequence
  Description of Artificial Sequence: Synthetic oligonucleotide
gggaugggauuucauguaacc

SEQ ID NO: 499 - RNA, 21 nt, Artificial Sequence
  Description of Artificial Sequence: Synthetic oligonucleotide
gggaugggauuucauguaacc

SEQ ID NO: 500 - RNA, 21 nt, Artificial Sequence
  Description of Artificial Sequence: Synthetic oligonucleotide
ggaugggauuucauguaacca

SEQ ID NO: 501 - RNA, 21 nt, Artificial Sequence
  Description of Artificial Sequence: Synthetic oligonucleotide
ggaugggauuucauguaacca

SEQ ID NO: 502 - RNA, 21 nt, Artificial Sequence
  Description of Artificial Sequence: Synthetic oligonucleotide
gaugggauuucauguaaccaa

SEQ ID NO: 503 - RNA, 21 nt, Artificial Sequence
  Description of Artificial Sequence: Synthetic oligonucleotide
gaugggauuucauguaaccaa

SEQ ID NO: 504 - RNA, 21 nt, Artificial Sequence
  Description of Artificial Sequence: Synthetic oligonucleotide
augggauuucauguaaccaag

SEQ ID NO: 505 - RNA, 21 nt, Artificial Sequence
  Description of Artificial Sequence: Synthetic oligonucleotide
augggauuucauguaaccaag

SEQ ID NO: 506 - RNA, 21 nt, Artificial Sequence
  Description of Artificial Sequence: Synthetic oligonucleotide
ugggauuucauguaaccaaga

SEQ ID NO: 507 - RNA, 21 nt, Artificial Sequence
  Description of Artificial Sequence: Synthetic oligonucleotide
ugggauuucauguaaccaaga

SEQ ID NO: 508 - RNA, 21 nt, Artificial Sequence
  Description of Artificial Sequence: Synthetic oligonucleotide
gggauuucauguaaccaagag

SEQ ID NO: 509 - RNA, 21 nt, Artificial Sequence
  Description of Artificial Sequence: Synthetic oligonucleotide
gggauuucauguaaccaagag

SEQ ID NO: 510 - RNA, 21 nt, Artificial Sequence
  Description of Artificial Sequence: Synthetic oligonucleotide
ggauuucauguaaccaagagu

SEQ ID NO: 511 - RNA, 21 nt, Artificial Sequence
  Description of Artificial Sequence: Synthetic oligonucleotide
ggauuucauguaaccaagagu

SEQ ID NO: 512 - RNA, 21 nt, Artificial Sequence
  Description of Artificial Sequence: Synthetic oligonucleotide
gauuucauguaaccaagagua

SEQ ID NO: 513 - RNA, 21 nt, Artificial Sequence
  Description of Artificial Sequence: Synthetic oligonucleotide
gauuucauguaaccaagagua

SEQ ID NO: 514 - RNA, 21 nt, Artificial Sequence
  Description of Artificial Sequence: Synthetic oligonucleotide
auuucauguaaccaagaguau

SEQ ID NO: 515 - RNA, 21 nt, Artificial Sequence
  Description of Artificial Sequence: Synthetic oligonucleotide
auuucauguaaccaagaguau

SEQ ID NO: 516 - RNA, 21 nt, Artificial Sequence
  Description of Artificial Sequence: Synthetic oligonucleotide
uuucauguaaccaagaguauu

SEQ ID NO: 517 - RNA, 21 nt, Artificial Sequence
  Description of Artificial Sequence: Synthetic oligonucleotide
uuucauguaaccaagaguauu

SEQ ID NO: 518 - RNA, 21 nt, Artificial Sequence
  Description of Artificial Sequence: Synthetic oligonucleotide
uucauguaaccaagaguauuc

SEQ ID NO: 519 - RNA, 21 nt, Artificial Sequence
  Description of Artificial Sequence: Synthetic oligonucleotide
uucauguaaccaagaguauuc

SEQ ID NO: 520 - RNA, 21 nt, Artificial Sequence
  Description of Artificial Sequence: Synthetic oligonucleotide
ucauguaaccaagaguauucc

SEQ ID NO: 521 - RNA, 21 nt, Artificial Sequence
  Description of Artificial Sequence: Synthetic oligonucleotide
ucauguaaccaagaguauucc

SEQ ID NO: 522 - RNA, 21 nt, Artificial Sequence
  Description of Artificial Sequence: Synthetic oligonucleotide
cauguaaccaagaguauucca

SEQ ID NO: 523 - RNA, 21 nt, Artificial Sequence
  Description of Artificial Sequence: Synthetic oligonucleotide
cauguaaccaagaguauucca

SEQ ID NO: 524 - RNA, 21 nt, Artificial Sequence
  Description of Artificial Sequence: Synthetic oligonucleotide
auguaaccaagaguauuccau

SEQ ID NO: 525 - RNA, 21 nt, Artificial Sequence
  Description of Artificial Sequence: Synthetic oligonucleotide
auguaaccaagaguauuccau

SEQ ID NO: 526 - RNA, 21 nt, Artificial Sequence
  Description of Artificial Sequence: Synthetic oligonucleotide
uguaaccaagaguauuccauu

SEQ ID NO: 527 - RNA, 21 nt, Artificial Sequence
  Description of Artificial Sequence: Synthetic oligonucleotide
uguaaccaagaguauuccauu

SEQ ID NO: 528 - RNA, 21 nt, Artificial Sequence
  Description of Artificial Sequence: Synthetic oligonucleotide
guaaccaagaguauuccauuu

SEQ ID NO: 529 - RNA, 21 nt, Artificial Sequence
  Description of Artificial Sequence: Synthetic oligonucleotide
guaaccaagaguauuccauuu

SEQ ID NO: 530 - RNA, 21 nt, Artificial Sequence
  Description of Artificial Sequence: Synthetic oligonucleotide
uaaccaagaguauuccauuuu

SEQ ID NO: 531 - RNA, 21 nt, Artificial Sequence
  Description of Artificial Sequence: Synthetic oligonucleotide
uaaccaagaguauuccauuuu

SEQ ID NO: 532 - RNA, 21 nt, Artificial Sequence
  Description of Artificial Sequence: Synthetic oligonucleotide
aaccaagaguauuccauuuuu

SEQ ID NO: 533 - RNA, 21 nt, Artificial Sequence
  Description of Artificial Sequence: Synthetic oligonucleotide
aaccaagaguauuccauuuuu

SEQ ID NO: 534 - RNA, 21 nt, Artificial Sequence
  Description of Artificial Sequence: Synthetic oligonucleotide
accaagaguauuccauuuuua

SEQ ID NO: 535 - RNA, 21 nt, Artificial Sequence
  Description of Artificial Sequence: Synthetic oligonucleotide
accaagaguauuccauuuuua

SEQ ID NO: 536 - RNA, 21 nt, Artificial Sequence
  Description of Artificial Sequence: Synthetic oligonucleotide
ccaagaguauuccauuuuuac

SEQ ID NO: 537 - RNA, 21 nt, Artificial Sequence
  Description of Artificial Sequence: Synthetic oligonucleotide
ccaagaguauuccauuuuuac

SEQ ID NO: 538 - RNA, 21 nt, Artificial Sequence
  Description of Artificial Sequence: Synthetic oligonucleotide
caagaguauuccauuuuuacu

SEQ ID NO: 539 - RNA, 21 nt, Artificial Sequence
  Description of Artificial Sequence: Synthetic oligonucleotide
caagaguauuccauuuuuacu

SEQ ID NO: 540 - RNA, 21 nt, Artificial Sequence
  Description of Artificial Sequence: Synthetic oligonucleotide
aagaguauuccauuuuuacua

SEQ ID NO: 541 - RNA, 21 nt, Artificial Sequence
  Description of Artificial Sequence: Synthetic oligonucleotide
aagaguauuccauuuuuacua

SEQ ID NO: 542 - RNA, 21 nt, Artificial Sequence
  Description of Artificial Sequence: Synthetic oligonucleotide
agaguauuccauuuuuacuaa

SEQ ID NO: 543 - RNA, 21 nt, Artificial Sequence
  Description of Artificial Sequence: Synthetic oligonucleotide
agaguauuccauuuuuacuaa

SEQ ID NO: 544 - RNA, 21 nt, Artificial Sequence
  Description of Artificial Sequence: Synthetic oligonucleotide
gaguauuccauuuuuacuaaa

SEQ ID NO: 545 - RNA, 21 nt, Artificial Sequence
  Description of Artificial Sequence: Synthetic oligonucleotide
gaguauuccauuuuuacuaaa

SEQ ID NO: 546 - RNA, 21 nt, Artificial Sequence
  Description of Artificial Sequence: Synthetic oligonucleotide
aguauuccauuuuuacuaaag

SEQ ID NO: 547 - RNA, 21 nt, Artificial Sequence
  Description of Artificial Sequence: Synthetic oligonucleotide
aguauuccauuuuuacuaaag

SEQ ID NO: 548 - RNA, 21 nt, Artificial Sequence
  Description of Artificial Sequence: Synthetic oligonucleotide
guauuccauuuuuacuaaagc

SEQ ID NO: 549 - RNA, 21 nt, Artificial Sequence
  Description of Artificial Sequence: Synthetic oligonucleotide
guauuccauuuuuacuaaagc

SEQ ID NO: 550 - RNA, 21 nt, Artificial Sequence
  Description of Artificial Sequence: Synthetic oligonucleotide
uauuccauuuuuacuaaagca

SEQ ID NO: 551 - RNA, 21 nt, Artificial Sequence
  Description of Artificial Sequence: Synthetic oligonucleotide
uauuccauuuuuacuaaagca

SEQ ID NO: 552 - RNA, 21 nt, Artificial Sequence
  Description of Artificial Sequence: Synthetic oligonucleotide
auuccauuuuuacuaaagcag

SEQ ID NO: 553 - RNA, 21 nt, Artificial Sequence
  Description of Artificial Sequence: Synthetic oligonucleotide
auuccauuuuuacuaaagcag

SEQ ID NO: 554 - RNA, 21 nt, Artificial Sequence
  Description of Artificial Sequence: Synthetic oligonucleotide
uuccauuuuuacuaaagcagu

SEQ ID NO: 555 - RNA, 21 nt, Artificial Sequence
  Description of Artificial Sequence: Synthetic oligonucleotide
uuccauuuuuacuaaagcagu

SEQ ID NO: 556 - RNA, 21 nt, Artificial Sequence
  Description of Artificial Sequence: Synthetic oligonucleotide
uccauuuuuacuaaagcagug

SEQ ID NO: 557 - RNA, 21 nt, Artificial Sequence
  Description of Artificial Sequence: Synthetic oligonucleotide
uccauuuuuacuaaagcagug

SEQ ID NO: 558 - RNA, 21 nt, Artificial Sequence
  Description of Artificial Sequence: Synthetic oligonucleotide
ccauuuuuacuaaagcagugu

SEQ ID NO: 559 - RNA, 21 nt, Artificial Sequence
  Description of Artificial Sequence: Synthetic oligonucleotide
ccauuuuuacuaaagcagugu

SEQ ID NO: 560 - RNA, 21 nt, Artificial Sequence
  Description of Artificial Sequence: Synthetic oligonucleotide
cauuuuuacuaaagcaguguu

SEQ ID NO: 561 - RNA, 21 nt, Artificial Sequence
  Description of Artificial Sequence: Synthetic oligonucleotide
cauuuuuacuaaagcaguguu

SEQ ID NO: 562 - RNA, 21 nt, Artificial Sequence
  Description of Artificial Sequence: Synthetic oligonucleotide
auuuuuacuaaagcaguguuu

SEQ ID NO: 563 - RNA, 21 nt, Artificial Sequence
  Description of Artificial Sequence: Synthetic oligonucleotide
auuuuuacuaaagcaguguuu

SEQ ID NO: 564 - RNA, 21 nt, Artificial Sequence
  Description of Artificial Sequence: Synthetic oligonucleotide
uuuuuacuaaagcaguguuuu

SEQ ID NO: 565 - RNA, 21 nt, Artificial Sequence
  Description of Artificial Sequence: Synthetic oligonucleotide
uuuuuacuaaagcaguguuuu

SEQ ID NO: 566 - RNA, 21 nt, Artificial Sequence
  Description of Artificial Sequence: Synthetic oligonucleotide
uuuuacuaaagcaguguuuuc

SEQ ID NO: 567 - RNA, 21 nt, Artificial Sequence
  Description of Artificial Sequence: Synthetic oligonucleotide
uuuuacuaaagcaguguuuuc

SEQ ID NO: 568 - RNA, 21 nt, Artificial Sequence
  Description of Artificial Sequence: Synthetic oligonucleotide
uuuacuaaagcaguguuuuca

SEQ ID NO: 569 - RNA, 21 nt, Artificial Sequence
  Description of Artificial Sequence: Synthetic oligonucleotide
uuuacuaaagcaguguuuuca

SEQ ID NO: 570 - RNA, 21 nt, Artificial Sequence
  Description of Artificial Sequence: Synthetic oligonucleotide
uuacuaaagcaguguuuucac

SEQ ID NO: 571 - RNA, 21 nt, Artificial Sequence
  Description of Artificial Sequence: Synthetic oligonucleotide
uuacuaaagcaguguuuucac

SEQ ID NO: 572 - RNA, 21 nt, Artificial Sequence
  Description of Artificial Sequence: Synthetic oligonucleotide
uacuaaagcaguguuuucacc

SEQ ID NO: 573 - RNA, 21 nt, Artificial Sequence
  Description of Artificial Sequence: Synthetic oligonucleotide
uacuaaagcaguguuuucacc

SEQ ID NO: 574 - RNA, 21 nt, Artificial Sequence
  Description of Artificial Sequence: Synthetic oligonucleotide
acuaaagcaguguuuucaccu

SEQ ID NO: 575 - RNA, 21 nt, Artificial Sequence
  Description of Artificial Sequence: Synthetic oligonucleotide
acuaaagcaguguuuucaccu

SEQ ID NO: 576 - RNA, 21 nt, Artificial Sequence
  Description of Artificial Sequence: Synthetic oligonucleotide
cuaaagcaguguuuucaccuc

SEQ ID NO: 577 - RNA, 21 nt, Artificial Sequence
  Description of Artificial Sequence: Synthetic oligonucleotide
cuaaagcaguguuuucaccuc

SEQ ID NO: 578 - RNA, 21 nt, Artificial Sequence
  Description of Artificial Sequence: Synthetic oligonucleotide
uaaagcaguguuuucaccuca

SEQ ID NO: 579 - RNA, 21 nt, Artificial Sequence
  Description of Artificial Sequence: Synthetic oligonucleotide
uaaagcaguguuuucaccuca

SEQ ID NO: 580 - RNA, 21 nt, Artificial Sequence
  Description of Artificial Sequence: Synthetic oligonucleotide
aaagcaguguuuucaccucau

SEQ ID NO: 581 - RNA, 21 nt, Artificial Sequence
  Description of Artificial Sequence: Synthetic oligonucleotide
aaagcaguguuuucaccucau

SEQ ID NO: 582 - RNA, 21 nt, Artificial Sequence
  Description of Artificial Sequence: Synthetic oligonucleotide
aagcaguguuuucaccucaua

SEQ ID NO: 583 - RNA, 21 nt, Artificial Sequence
  Description of Artificial Sequence: Synthetic oligonucleotide
aagcaguguuuucaccucaua

SEQ ID NO: 584 - RNA, 21 nt, Artificial Sequence
  Description of Artificial Sequence: Synthetic oligonucleotide
agcaguguuuucaccucauau

SEQ ID NO: 585 - RNA, 21 nt, Artificial Sequence
  Description of Artificial Sequence: Synthetic oligonucleotide
agcaguguuuucaccucauau

SEQ ID NO: 586 - RNA, 21 nt, Artificial Sequence
  Description of Artificial Sequence: Synthetic oligonucleotide
gcaguguuuucaccucauaug

SEQ ID NO: 587 - RNA, 21 nt, Artificial Sequence
  Description of Artificial Sequence: Synthetic oligonucleotide
gcaguguuuucaccucauaug

SEQ ID NO: 588 - RNA, 21 nt, Artificial Sequence
  Description of Artificial Sequence: Synthetic oligonucleotide
caguguuuucaccucauaugc

SEQ ID NO: 589 - RNA, 21 nt, Artificial Sequence
  Description of Artificial Sequence: Synthetic oligonucleotide
caguguuuucaccucauaugc

SEQ ID NO: 590 - RNA, 21 nt, Artificial Sequence
  Description of Artificial Sequence: Synthetic oligonucleotide
aguguuuucaccucauaugcu

SEQ ID NO: 591 - RNA, 21 nt, Artificial Sequence
  Description of Artificial Sequence: Synthetic oligonucleotide
aguguuuucaccucauaugcu

SEQ ID NO: 592 - RNA, 21 nt, Artificial Sequence
  Description of Artificial Sequence: Synthetic oligonucleotide
guguuuucaccucauaugcua

SEQ ID NO: 593 - RNA, 21 nt, Artificial Sequence
  Description of Artificial Sequence: Synthetic oligonucleotide
guguuuucaccucauaugcua

SEQ ID NO: 594 - RNA, 21 nt, Artificial Sequence
  Description of Artificial Sequence: Synthetic oligonucleotide
uguuuucaccucauaugcuau

SEQ ID NO: 595 - RNA, 21 nt, Artificial Sequence
  Description of Artificial Sequence: Synthetic oligonucleotide
uguuuucaccucauaugcuau

SEQ ID NO: 596 - RNA, 21 nt, Artificial Sequence
  Description of Artificial Sequence: Synthetic oligonucleotide
guuuucaccucauaugcuaug

SEQ ID NO: 597 - RNA, 21 nt, Artificial Sequence
  Description of Artificial Sequence: Synthetic oligonucleotide
guuuucaccucauaugcuaug

SEQ ID NO: 598 - RNA, 21 nt, Artificial Sequence
  Description of Artificial Sequence: Synthetic oligonucleotide
uuuucaccucauaugcuaugu

SEQ ID NO: 599 - RNA, 21 nt, Artificial Sequence
  Description of Artificial Sequence: Synthetic oligonucleotide
uuuucaccucauaugcuaugu

SEQ ID NO: 600 - RNA, 21 nt, Artificial Sequence
  Description of Artificial Sequence: Synthetic oligonucleotide
uuucaccucauaugcuauguu

SEQ ID NO: 601 - RNA, 21 nt, Artificial Sequence
  Description of Artificial Sequence: Synthetic oligonucleotide
uuucaccucauaugcuauguu

SEQ ID NO: 602 - RNA, 21 nt, Artificial Sequence
  Description of Artificial Sequence: Synthetic oligonucleotide
uucaccucauaugcuauguua

SEQ ID NO: 603 - RNA, 21 nt, Artificial Sequence
  Description of Artificial Sequence: Synthetic oligonucleotide
uucaccucauaugcuauguua

SEQ ID NO: 604 - RNA, 21 nt, Artificial Sequence
  Description of Artificial Sequence: Synthetic oligonucleotide
ucaccucauaugcuauguuag

SEQ ID NO: 605 - RNA, 21 nt, Artificial Sequence
  Description of Artificial Sequence: Synthetic oligonucleotide
ucaccucauaugcuauguuag

SEQ ID NO: 606 - RNA, 21 nt, Artificial Sequence
  Description of Artificial Sequence: Synthetic oligonucleotide
caccucauaugcuauguuaga

SEQ ID NO: 607 - RNA, 21 nt, Artificial Sequence
  Description of Artificial Sequence: Synthetic oligonucleotide
caccucauaugcuauguuaga

SEQ ID NO: 608 - RNA, 21 nt, Artificial Sequence
  Description of Artificial Sequence: Synthetic oligonucleotide
accucauaugcuauguuagaa

SEQ ID NO: 609 - RNA, 21 nt, Artificial Sequence
  Description of Artificial Sequence: Synthetic oligonucleotide
accucauaugcuauguuagaa

SEQ ID NO: 610 - RNA, 21 nt, Artificial Sequence
  Description of Artificial Sequence: Synthetic oligonucleotide
ccucauaugcuauguuagaag

SEQ ID NO: 611 - RNA, 21 nt, Artificial Sequence
  Description of Artificial Sequence: Synthetic oligonucleotide
ccucauaugcuauguuagaag

SEQ ID NO: 612 - RNA, 21 nt, Artificial Sequence
  Description of Artificial Sequence: Synthetic oligonucleotide
cucauaugcuauguuagaagu

SEQ ID NO: 613 - RNA, 21 nt, Artificial Sequence
  Description of Artificial Sequence: Synthetic oligonucleotide
cucauaugcuauguuagaagu

SEQ ID NO: 614 - RNA, 21 nt, Artificial Sequence
  Description of Artificial Sequence: Synthetic oligonucleotide
ucauaugcuauguuagaaguc

SEQ ID NO: 615 - RNA, 21 nt, Artificial Sequence
  Description of Artificial Sequence: Synthetic oligonucleotide
ucauaugcuauguuagaaguc

SEQ ID NO: 616 - RNA, 21 nt, Artificial Sequence
  Description of Artificial Sequence: Synthetic oligonucleotide
cauaugcuauguuagaagucc

SEQ ID NO: 617 - RNA, 21 nt, Artificial Sequence
  Description of Artificial Sequence: Synthetic oligonucleotide
cauaugcuauguuagaagucc

SEQ ID NO: 618 - RNA, 21 nt, Artificial Sequence
  Description of Artificial Sequence: Synthetic oligonucleotide
auaugcuauguuagaagucca

SEQ ID NO: 619 - RNA, 21 nt, Artificial Sequence
  Description of Artificial Sequence: Synthetic oligonucleotide
auaugcuauguuagaagucca

SEQ ID NO: 620 - RNA, 21 nt, Artificial Sequence
  Description of Artificial Sequence: Synthetic oligonucleotide
uaugcuauguuagaaguccag

SEQ ID NO: 621 - RNA, 21 nt, Artificial Sequence
  Description of Artificial Sequence: Synthetic oligonucleotide
uaugcuauguuagaaguccag

SEQ ID NO: 622 - RNA, 21 nt, Artificial Sequence
  Description of Artificial Sequence: Synthetic oligonucleotide
augcuauguuagaaguccagg

SEQ ID NO: 623 - RNA, 21 nt, Artificial Sequence
  Description of Artificial Sequence: Synthetic oligonucleotide
augcuauguuagaaguccagg

SEQ ID NO: 624 - RNA, 21 nt, Artificial Sequence
  Description of Artificial Sequence: Synthetic oligonucleotide
ugcuauguuagaaguccaggc

SEQ ID NO: 625 - RNA, 21 nt, Artificial Sequence
  Description of Artificial Sequence: Synthetic oligonucleotide
ugcuauguuagaaguccaggc

SEQ ID NO: 626 - RNA, 21 nt, Artificial Sequence
  Description of Artificial Sequence: Synthetic oligonucleotide
gcuauguuagaaguccaggca

SEQ ID NO: 627 - RNA, 21 nt, Artificial Sequence
  Description of Artificial Sequence: Synthetic oligonucleotide
gcuauguuagaaguccaggca

SEQ ID NO: 628 - RNA, 21 nt, Artificial Sequence
  Description of Artificial Sequence: Synthetic oligonucleotide
cuauguuagaaguccaggcag

SEQ ID NO: 629 - RNA, 21 nt, Artificial Sequence
  Description of Artificial Sequence: Synthetic oligonucleotide
cuauguuagaaguccaggcag

SEQ ID NO: 630 - RNA, 21 nt, Artificial Sequence
  Description of Artificial Sequence: Synthetic oligonucleotide
uauguuagaaguccaggcaga

SEQ ID NO: 631 - RNA, 21 nt, Artificial Sequence
  Description of Artificial Sequence: Synthetic oligonucleotide
uauguuagaaguccaggcaga

SEQ ID NO: 632 - RNA, 21 nt, Artificial Sequence
  Description of Artificial Sequence: Synthetic oligonucleotide
auguuagaaguccaggcagag

SEQ ID NO: 633 - RNA, 21 nt, Artificial Sequence
  Description of Artificial Sequence: Synthetic oligonucleotide
auguuagaaguccaggcagag

SEQ ID NO: 634 - RNA, 21 nt, Artificial Sequence
  Description of Artificial Sequence: Synthetic oligonucleotide
uguuagaaguccaggcagaga

SEQ ID NO: 635 - RNA, 21 nt, Artificial Sequence
  Description of Artificial Sequence: Synthetic oligonucleotide
uguuagaaguccaggcagaga

SEQ ID NO: 636 - RNA, 21 nt, Artificial Sequence
  Description of Artificial Sequence: Synthetic oligonucleotide
guuagaaguccaggcagagac

SEQ ID NO: 637 - RNA, 21 nt, Artificial Sequence
  Description of Artificial Sequence: Synthetic oligonucleotide
guuagaaguccaggcagagac

SEQ ID NO: 638 - RNA, 21 nt, Artificial Sequence
  Description of Artificial Sequence: Synthetic oligonucleotide
uuagaaguccaggcagagaca

SEQ ID NO: 639 - RNA, 21 nt, Artificial Sequence
  Description of Artificial Sequence: Synthetic oligonucleotide
uuagaaguccaggcagagaca

SEQ ID NO: 640 - RNA, 21 nt, Artificial Sequence
  Description of Artificial Sequence: Synthetic oligonucleotide
uagaaguccaggcagagacaa

SEQ ID NO: 641 - RNA, 21 nt, Artificial Sequence
  Description of Artificial Sequence: Synthetic oligonucleotide
uagaaguccaggcagagacaa

SEQ ID NO: 642 - RNA, 21 nt, Artificial Sequence
  Description of Artificial Sequence: Synthetic oligonucleotide
agaaguccaggcagagacaau

SEQ ID NO: 643 - RNA, 21 nt, Artificial Sequence
  Description of Artificial Sequence: Synthetic oligonucleotide
agaaguccaggcagagacaau

SEQ ID NO: 644 - RNA, 21 nt, Artificial Sequence
  Description of Artificial Sequence: Synthetic oligonucleotide
gaaguccaggcagagacaaua

SEQ ID NO: 645 - RNA, 21 nt, Artificial Sequence
  Description of Artificial Sequence: Synthetic oligonucleotide
gaaguccaggcagagacaaua

SEQ ID NO: 646 - RNA, 21 nt, Artificial Sequence
  Description of Artificial Sequence: Synthetic oligonucleotide
aaguccaggcagagacaauaa

SEQ ID NO: 647 - RNA, 21 nt, Artificial Sequence
  Description of Artificial Sequence: Synthetic oligonucleotide
aaguccaggcagagacaauaa

SEQ ID NO: 648 - RNA, 21 nt, Artificial Sequence
  Description of Artificial Sequence: Synthetic oligonucleotide
aguccaggcagagacaauaaa

SEQ ID NO: 649 - RNA, 21 nt, Artificial Sequence
  Description of Artificial Sequence: Synthetic oligonucleotide
aguccaggcagagacaauaaa

SEQ ID NO: 650 - RNA, 21 nt, Artificial Sequence
  Description of Artificial Sequence: Synthetic oligonucleotide
guccaggcagagacaauaaaa

SEQ ID NO: 651 - RNA, 21 nt, Artificial Sequence
  Description of Artificial Sequence: Synthetic oligonucleotide
guccaggcagagacaauaaaa

SEQ ID NO: 652 - RNA, 21 nt, Artificial Sequence
  Description of Artificial Sequence: Synthetic oligonucleotide
uccaggcagagacaauaaaac

SEQ ID NO: 653 - RNA, 21 nt, Artificial Sequence
  Description of Artificial Sequence: Synthetic oligonucleotide
uccaggcagagacaauaaaac

SEQ ID NO: 654 - RNA, 21 nt, Artificial Sequence
  Description of Artificial Sequence: Synthetic oligonucleotide
ccaggcagagacaauaaaaca

SEQ ID NO: 655 - RNA, 21 nt, Artificial Sequence
  Description of Artificial Sequence: Synthetic oligonucleotide
ccaggcagagacaauaaaaca

SEQ ID NO: 656 - RNA, 21 nt, Artificial Sequence
  Description of Artificial Sequence: Synthetic oligonucleotide
caggcagagacaauaaaacau

SEQ ID NO: 657 - RNA, 21 nt, Artificial Sequence
  Description of Artificial Sequence: Synthetic oligonucleotide
caggcagagacaauaaaacau

SEQ ID NO: 658 - RNA, 21 nt, Artificial Sequence
  Description of Artificial Sequence: Synthetic oligonucleotide
aggcagagacaauaaaacauu

SEQ ID NO: 659 - RNA, 21 nt, Artificial Sequence
  Description of Artificial Sequence: Synthetic oligonucleotide
aggcagagacaauaaaacauu

SEQ ID NO: 660 - RNA, 21 nt, Artificial Sequence
  Description of Artificial Sequence: Synthetic oligonucleotide
ggcagagacaauaaaacauuc

SEQ ID NO: 661 - RNA, 21 nt, Artificial Sequence
  Description of Artificial Sequence: Synthetic oligonucleotide
ggcagagacaauaaaacauuc

SEQ ID NO: 662 - RNA, 21 nt, Artificial Sequence
  Description of Artificial Sequence: Synthetic oligonucleotide
gcagagacaauaaaacauucc

SEQ ID NO: 663 - RNA, 21 nt, Artificial Sequence
  Description of Artificial Sequence: Synthetic oligonucleotide
gcagagacaauaaaacauucc

SEQ ID NO: 664 - RNA, 21 nt, Artificial Sequence
  Description of Artificial Sequence: Synthetic oligonucleotide
cagagacaauaaaacauuccu

SEQ ID NO: 665 - RNA, 21 nt, Artificial Sequence
  Description of Artificial Sequence: Synthetic oligonucleotide
cagagacaauaaaacauuccu

SEQ ID NO: 666 - RNA, 21 nt, Artificial Sequence
  Description of Artificial Sequence: Synthetic oligonucleotide
agagacaauaaaacauuccug

SEQ ID NO: 667 - RNA, 21 nt, Artificial Sequence
  Description of Artificial Sequence: Synthetic oligonucleotide
agagacaauaaaacauuccug

SEQ ID NO: 668 - RNA, 21 nt, Artificial Sequence
  Description of Artificial Sequence: Synthetic oligonucleotide
gagacaauaaaacauuccugu

SEQ ID NO: 669 - RNA, 21 nt, Artificial Sequence
  Description of Artificial Sequence: Synthetic oligonucleotide
gagacaauaaaacauuccugu

SEQ ID NO: 670 - RNA, 21 nt, Artificial Sequence
  Description of Artificial Sequence: Synthetic oligonucleotide
agacaauaaaacauuccugug

SEQ ID NO: 671 - RNA, 21 nt, Artificial Sequence
  Description of Artificial Sequence: Synthetic oligonucleotide
agacaauaaaacauuccugug

SEQ ID NO: 672 - RNA, 21 nt, Artificial Sequence
  Description of Artificial Sequence: Synthetic oligonucleotide
gacaauaaaacauuccuguga

SEQ ID NO: 673 - RNA, 21 nt, Artificial Sequence
  Description of Artificial Sequence: Synthetic oligonucleotide
gacaauaaaacauuccuguga

SEQ ID NO: 674 - RNA, 21 nt, Artificial Sequence
  Description of Artificial Sequence: Synthetic oligonucleotide
acaauaaaacauuccugugaa

SEQ ID NO: 675 - RNA, 21 nt, Artificial Sequence
  Description of Artificial Sequence: Synthetic oligonucleotide
acaauaaaacauuccugugaa

SEQ ID NO: 676 - RNA, 21 nt, Artificial Sequence
  Description of Artificial Sequence: Synthetic oligonucleotide
caauaaaacauuccugugaaa

SEQ ID NO: 677 - RNA, 21 nt, Artificial Sequence
  Description of Artificial Sequence: Synthetic oligonucleotide
caauaaaacauuccugugaaa

SEQ ID NO: 678 - RNA, 21 nt, Artificial Sequence
  Description of Artificial Sequence: Synthetic oligonucleotide
aauaaaacauuccugugaaag

SEQ ID NO: 679 - RNA, 21 nt, Artificial Sequence
  Description of Artificial Sequence: Synthetic oligonucleotide
aauaaaacauuccugugaaag

SEQ ID NO: 680 - RNA, 21 nt, Artificial Sequence
  Description of Artificial Sequence: Synthetic oligonucleotide
auaaaacauuccugugaaagg

SEQ ID NO: 681 - RNA, 21 nt, Artificial Sequence
  Description of Artificial Sequence: Synthetic oligonucleotide
auaaaacauuccugugaaagg

SEQ ID NO: 682 - RNA, 21 nt, Artificial Sequence
  Description of Artificial Sequence: Synthetic oligonucleotide
uaaaacauuccugugaaaggc

SEQ ID NO: 683 - RNA, 21 nt, Artificial Sequence
  Description of Artificial Sequence: Synthetic oligonucleotide
uaaaacauuccugugaaaggc

SEQ ID NO: 684 - RNA, 21 nt, Artificial Sequence
  Description of Artificial Sequence: Synthetic oligonucleotide
aaaacauuccugugaaaggca

SEQ ID NO: 685 - RNA, 21 nt, Artificial Sequence
  Description of Artificial Sequence: Synthetic oligonucleotide
aaaacauuccugugaaaggca

SEQ ID NO: 686 - RNA, 21 nt, Artificial Sequence
  Description of Artificial Sequence: Synthetic oligonucleotide
aaacauuccugugaaaggcac

SEQ ID NO: 687 - RNA, 21 nt, Artificial Sequence
  Description of Artificial Sequence: Synthetic oligonucleotide
aaacauuccugugaaaggcac

SEQ ID NO: 688 - RNA, 21 nt, Artificial Sequence
  Description of Artificial Sequence: Synthetic oligonucleotide
aacauuccugugaaaggcacu

SEQ ID NO: 689 - RNA, 21 nt, Artificial Sequence
  Description of Artificial Sequence: Synthetic oligonucleotide
aacauuccugugaaaggcacu

SEQ ID NO: 690 - RNA, 21 nt, Artificial Sequence
  Description of Artificial Sequence: Synthetic oligonucleotide
acauuccugugaaaggcacuu

SEQ ID NO: 691 - RNA, 21 nt, Artificial Sequence
  Description of Artificial Sequence: Synthetic oligonucleotide
acauuccugugaaaggcacuu

SEQ ID NO: 692 - RNA, 21 nt, Artificial Sequence
  Description of Artificial Sequence: Synthetic oligonucleotide
cauuccugugaaaggcacuuu

SEQ ID NO: 693 - RNA, 21 nt, Artificial Sequence
  Description of Artificial Sequence: Synthetic oligonucleotide
cauuccugugaaaggcacuuu

SEQ ID NO: 694 - RNA, 21 nt, Artificial Sequence
  Description of Artificial Sequence: Synthetic oligonucleotide
auuccugugaaaggcacuuuu

SEQ ID NO: 695 - RNA, 21 nt, Artificial Sequence
  Description of Artificial Sequence: Synthetic oligonucleotide
auuccugugaaaggcacuuuu

SEQ ID NO: 696 - RNA, 21 nt, Artificial Sequence
  Description of Artificial Sequence: Synthetic oligonucleotide
uuccugugaaaggcacuuuuc

SEQ ID NO: 697 - RNA, 21 nt, Artificial Sequence
  Description of Artificial Sequence: Synthetic oligonucleotide
uuccugugaaaggcacuuuuc

SEQ ID NO: 698 - RNA, 21 nt, Artificial Sequence
  Description of Artificial Sequence: Synthetic oligonucleotide
uccugugaaaggcacuuuuca

SEQ ID NO: 699 - RNA, 21 nt, Artificial Sequence
  Description of Artificial Sequence: Synthetic oligonucleotide
uccugugaaaggcacuuuuca

SEQ ID NO: 700 - RNA, 21 nt, Artificial Sequence
  Description of Artificial Sequence: Synthetic oligonucleotide
ccugugaaaggcacuuuucau

SEQ ID NO: 701 - RNA, 21 nt, Artificial Sequence
  Description of Artificial Sequence: Synthetic oligonucleotide
ccugugaaaggcacuuuucau

SEQ ID NO: 702 - RNA, 21 nt, Artificial Sequence
  Description of Artificial Sequence: Synthetic oligonucleotide
cugugaaaggcacuuuucauu

SEQ ID NO: 703 - RNA, 21 nt, Artificial Sequence
  Description of Artificial Sequence: Synthetic oligonucleotide
cugugaaaggcacuuuucauu

SEQ ID NO: 704 - RNA, 21 nt, Artificial Sequence
  Description of Artificial Sequence: Synthetic oligonucleotide
ugugaaaggcacuuuucauuc

SEQ ID NO: 705 - RNA, 21 nt, Artificial Sequence
  Description of Artificial Sequence: Synthetic oligonucleotide
ugugaaaggcacuuuucauuc

SEQ ID NO: 706 - RNA, 21 nt, Artificial Sequence
  Description of Artificial Sequence: Synthetic oligonucleotide
gugaaaggcacuuuucauucc

SEQ ID NO: 707 - RNA, 21 nt, Artificial Sequence
  Description of Artificial Sequence: Synthetic oligonucleotide
gugaaaggcacuuuucauucc

SEQ ID NO: 708 - RNA, 21 nt, Artificial Sequence
  Description of Artificial Sequence: Synthetic oligonucleotide
ugaaaggcacuuuucauucca

SEQ ID NO: 709 - RNA, 21 nt, Artificial Sequence
  Description of Artificial Sequence: Synthetic oligonucleotide
ugaaaggcacuuuucauucca

SEQ ID NO: 710 - RNA, 21 nt, Artificial Sequence
  Description of Artificial Sequence: Synthetic oligonucleotide
gaaaggcacuuuucauuccac

SEQ ID NO: 711 - RNA, 21 nt, Artificial Sequence
  Description of Artificial Sequence: Synthetic oligonucleotide
gaaaggcacuuuucauuccac

SEQ ID NO: 712 - RNA, 21 nt, Artificial Sequence
  Description of Artificial Sequence: Synthetic oligonucleotide
aaaggcacuuuucauuccacu

SEQ ID NO: 713 - RNA, 21 nt, Artificial Sequence
  Description of Artificial Sequence: Synthetic oligonucleotide
aaaggcacuuuucauuccacu

SEQ ID NO: 714 - RNA, 21 nt, Artificial Sequence
  Description of Artificial Sequence: Synthetic oligonucleotide
aaggcacuuuucauuccacuu

SEQ ID NO: 715 - RNA, 21 nt, Artificial Sequence
  Description of Artificial Sequence: Synthetic oligonucleotide
aaggcacuuuucauuccacuu

SEQ ID NO: 716 - RNA, 21 nt, Artificial Sequence
  Description of Artificial Sequence: Synthetic oligonucleotide
aggcacuuuucauuccacuuu

SEQ ID NO: 717 - RNA, 21 nt, Artificial Sequence
  Description of Artificial Sequence: Synthetic oligonucleotide
aggcacuuuucauuccacuuu

SEQ ID NO: 718 - RNA, 21 nt, Artificial Sequence
  Description of Artificial Sequence: Synthetic oligonucleotide
ggcacuuuucauuccacuuua

SEQ ID NO: 719 - RNA, 21 nt, Artificial Sequence
  Description of Artificial Sequence: Synthetic oligonucleotide
ggcacuuuucauuccacuuua

SEQ ID NO: 720 - RNA, 21 nt, Artificial Sequence
  Description of Artificial Sequence: Synthetic oligonucleotide
gcacuuuucauuccacuuuaa

SEQ ID NO: 721 - RNA, 21 nt, Artificial Sequence
  Description of Artificial Sequence: Synthetic oligonucleotide
gcacuuuucauuccacuuuaa

SEQ ID NO: 722 - RNA, 21 nt, Artificial Sequence
  Description of Artificial Sequence: Synthetic oligonucleotide
cacuuuucauuccacuuuaac

SEQ ID NO: 723 - RNA, 21 nt, Artificial Sequence
  Description of Artificial Sequence: Synthetic oligonucleotide
cacuuuucauuccacuuuaac

SEQ ID NO: 724 - RNA, 21 nt, Artificial Sequence
  Description of Artificial Sequence: Synthetic oligonucleotide
acuuuucauuccacuuuaacu

SEQ ID NO: 725 - RNA, 21 nt, Artificial Sequence
  Description of Artificial Sequence: Synthetic oligonucleotide
acuuuucauuccacuuuaacu

SEQ ID NO: 726 - RNA, 21 nt, Artificial Sequence
  Description of Artificial Sequence: Synthetic oligonucleotide
cuuuucauuccacuuuaacuu

SEQ ID NO: 727 - RNA, 21 nt, Artificial Sequence
  Description of Artificial Sequence: Synthetic oligonucleotide
cuuuucauuccacuuuaacuu

SEQ ID NO: 728 - RNA, 21 nt, Artificial Sequence
  Description of Artificial Sequence: Synthetic oligonucleotide
uuuucauuccacuuuaacuug

SEQ ID NO: 729 - RNA, 21 nt, Artificial Sequence
  Description of Artificial Sequence: Synthetic oligonucleotide
uuuucauuccacuuuaacuug

SEQ ID NO: 730 - RNA, 21 nt, Artificial Sequence
  Description of Artificial Sequence: Synthetic oligonucleotide
uuucauuccacuuuaacuuga

SEQ ID NO: 731 - RNA, 21 nt, Artificial Sequence
  Description of Artificial Sequence: Synthetic oligonucleotide
uuucauuccacuuuaacuuga

SEQ ID NO: 732 - RNA, 21 nt, Artificial Sequence
  Description of Artificial Sequence: Synthetic oligonucleotide
uucauuccacuuuaacuugau

SEQ ID NO: 733 - RNA, 21 nt, Artificial Sequence
  Description of Artificial Sequence: Synthetic oligonucleotide
uucauuccacuuuaacuugau

SEQ ID NO: 734 - RNA, 21 nt, Artificial Sequence
  Description of Artificial Sequence: Synthetic oligonucleotide
ucauuccacuuuaacuugauu

SEQ ID NO: 735 - RNA, 21 nt, Artificial Sequence
  Description of Artificial Sequence: Synthetic oligonucleotide
ucauuccacuuuaacuugauu

SEQ ID NO: 736 - RNA, 21 nt, Artificial Sequence
  Description of Artificial Sequence: Synthetic oligonucleotide
cauuccacuuuaacuugauuu

SEQ ID NO: 737 - RNA, 21 nt, Artificial Sequence
  Description of Artificial Sequence: Synthetic oligonucleotide
cauuccacuuuaacuugauuu

SEQ ID NO: 738 - RNA, 21 nt, Artificial Sequence
  Description of Artificial Sequence: Synthetic oligonucleotide
auuccacuuuaacuugauuuu

SEQ ID NO: 739 - RNA, 21 nt, Artificial Sequence
  Description of Artificial Sequence: Synthetic oligonucleotide
auuccacuuuaacuugauuuu

SEQ ID NO: 740 - RNA, 21 nt, Artificial Sequence
  Description of Artificial Sequence: Synthetic oligonucleotide
uuccacuuuaacuugauuuuu

SEQ ID NO: 741 - RNA, 21 nt, Artificial Sequence
  Description of Artificial Sequence: Synthetic oligonucleotide
uuccacuuuaacuugauuuuu

SEQ ID NO: 742 - RNA, 21 nt, Artificial Sequence
  Description of Artificial Sequence: Synthetic oligonucleotide
uccacuuuaacuugauuuuuu

SEQ ID NO: 743 - RNA, 21 nt, Artificial Sequence
  Description of Artificial Sequence: Synthetic oligonucleotide
uccacuuuaacuugauuuuuu

SEQ ID NO: 744 - RNA, 21 nt, Artificial Sequence
  Description of Artificial Sequence: Synthetic oligonucleotide
ccacuuuaacuugauuuuuua

SEQ ID NO: 745 - RNA, 21 nt, Artificial Sequence
  Description of Artificial Sequence: Synthetic oligonucleotide
ccacuuuaacuugauuuuuua

SEQ ID NO: 746 - RNA, 21 nt, Artificial Sequence
  Description of Artificial Sequence: Synthetic oligonucleotide
cacuuuaacuugauuuuuuaa

SEQ ID NO: 747 - RNA, 21 nt, Artificial Sequence
  Description of Artificial Sequence: Synthetic oligonucleotide
cacuuuaacuugauuuuuuaa

SEQ ID NO: 748 - RNA, 21 nt, Artificial Sequence
  Description of Artificial Sequence: Synthetic oligonucleotide
acuuuaacuugauuuuuuaaa

SEQ ID NO: 749 - RNA, 21 nt, Artificial Sequence
  Description of Artificial Sequence: Synthetic oligonucleotide
acuuuaacuugauuuuuuaaa

SEQ ID NO: 750 - RNA, 21 nt, Artificial Sequence
  Description of Artificial Sequence: Synthetic oligonucleotide
cuuuaacuugauuuuuuaaau

SEQ ID NO: 751 - RNA, 21 nt, Artificial Sequence
  Description of Artificial Sequence: Synthetic oligonucleotide
cuuuaacuugauuuuuuaaau

SEQ ID NO: 752 - RNA, 21 nt, Artificial Sequence
  Description of Artificial Sequence: Synthetic oligonucleotide
uuuaacuugauuuuuuaaauu

SEQ ID NO: 753 - RNA, 21 nt, Artificial Sequence
  Description of Artificial Sequence: Synthetic oligonucleotide
uuuaacuugauuuuuuaaauu

SEQ ID NO: 754 - RNA, 21 nt, Artificial Sequence
  Description of Artificial Sequence: Synthetic oligonucleotide
uuaacuugauuuuuuaaauuc

SEQ ID NO: 755 - RNA, 21 nt, Artificial Sequence
  Description of Artificial Sequence: Synthetic oligonucleotide
uuaacuugauuuuuuaaauuc

SEQ ID NO: 756 - RNA, 21 nt, Artificial Sequence
  Description of Artificial Sequence: Synthetic oligonucleotide
uaacuugauuuuuuaaauucc

SEQ ID NO: 757 - RNA, 21 nt, Artificial Sequence
  Description of Artificial Sequence: Synthetic oligonucleotide
uaacuugauuuuuuaaauucc

SEQ ID NO: 758 - RNA, 21 nt, Artificial Sequence
  Description of Artificial Sequence: Synthetic oligonucleotide
aacuugauuuuuuaaauuccc

SEQ ID NO: 759 - RNA, 21 nt, Artificial Sequence
  Description of Artificial Sequence: Synthetic oligonucleotide
aacuugauuuuuuaaauuccc

SEQ ID NO: 760 - RNA, 21 nt, Artificial Sequence
  Description of Artificial Sequence: Synthetic oligonucleotide
acuugauuuuuuaaauucccu

SEQ ID NO: 761 - RNA, 21 nt, Artificial Sequence
  Description of Artificial Sequence: Synthetic oligonucleotide
acuugauuuuuuaaauucccu

SEQ ID NO: 762 - RNA, 21 nt, Artificial Sequence
  Description of Artificial Sequence: Synthetic oligonucleotide
cuugauuuuuuaaauucccuu

SEQ ID NO: 763 - RNA, 21 nt, Artificial Sequence
  Description of Artificial Sequence: Synthetic oligonucleotide
cuugauuuuuuaaauucccuu

SEQ ID NO: 764 - RNA, 21 nt, Artificial Sequence
  Description of Artificial Sequence: Synthetic oligonucleotide
uugauuuuuuaaauucccuua

SEQ ID NO: 765 - RNA, 21 nt, Artificial Sequence
  Description of Artificial Sequence: Synthetic oligonucleotide
uugauuuuuuaaauucccuua

SEQ ID NO: 766 - RNA, 21 nt, Artificial Sequence
  Description of Artificial Sequence: Synthetic oligonucleotide
ugauuuuuuaaauucccuuau

SEQ ID NO: 767 - RNA, 21 nt, Artificial Sequence
  Description of Artificial Sequence: Synthetic oligonucleotide
ugauuuuuuaaauucccuuau

SEQ ID NO: 768 - RNA, 21 nt, Artificial Sequence
  Description of Artificial Sequence: Synthetic oligonucleotide
gauuuuuuaaauucccuuauu

SEQ ID NO: 769 - RNA, 21 nt, Artificial Sequence
  Description of Artificial Sequence: Synthetic oligonucleotide
gauuuuuuaaauucccuuauu

SEQ ID NO: 770 - RNA, 21 nt, Artificial Sequence
  Description of Artificial Sequence: Synthetic oligonucleotide
auuuuuuaaauucccuuauug

SEQ ID NO: 771 - RNA, 21 nt, Artificial Sequence
  Description of Artificial Sequence: Synthetic oligonucleotide
auuuuuuaaauucccuuauug

SEQ ID NO: 772 - RNA, 21 nt, Artificial Sequence
  Description of Artificial Sequence: Synthetic oligonucleotide
uuuuuuaaauucccuuauugu

SEQ ID NO: 773 - RNA, 21 nt, Artificial Sequence
  Description of Artificial Sequence: Synthetic oligonucleotide
uuuuuuaaauucccuuauugu

SEQ ID NO: 774 - RNA, 21 nt, Artificial Sequence
  Description of Artificial Sequence: Synthetic oligonucleotide
uuuuuaaauucccuuauuguc

SEQ ID NO: 775 - RNA, 21 nt, Artificial Sequence
  Description of Artificial Sequence: Synthetic oligonucleotide
uuuuuaaauucccuuauuguc

SEQ ID NO: 776 - RNA, 21 nt, Artificial Sequence
  Description of Artificial Sequence: Synthetic oligonucleotide
uuuuaaauucccuuauugucc

SEQ ID NO: 777 - RNA, 21 nt, Artificial Sequence
  Description of Artificial Sequence: Synthetic oligonucleotide
uuuuaaauucccuuauugucc

SEQ ID NO: 778 - RNA, 21 nt, Artificial Sequence
  Description of Artificial Sequence: Synthetic oligonucleotide
uuuaaauucccuuauuguccc

SEQ ID NO: 779 - RNA, 21 nt, Artificial Sequence
  Description of Artificial Sequence: Synthetic oligonucleotide
uuuaaauucccuuauuguccc

SEQ ID NO: 780 - RNA, 21 nt, Artificial Sequence
  Description of Artificial Sequence: Synthetic oligonucleotide
uuaaauucccuuauugucccu

SEQ ID NO: 781 - RNA, 21 nt, Artificial Sequence
  Description of Artificial Sequence: Synthetic oligonucleotide
uuaaauucccuuauugucccu

SEQ ID NO: 782 - RNA, 21 nt, Artificial Sequence
  Description of Artificial Sequence: Synthetic oligonucleotide
uaaauucccuuauugucccuu

SEQ ID NO: 783 - RNA, 21 nt, Artificial Sequence
  Description of Artificial Sequence: Synthetic oligonucleotide
uaaauucccuuauugucccuu

SEQ ID NO: 784 - RNA, 21 nt, Artificial Sequence
  Description of Artificial Sequence: Synthetic oligonucleotide
aaauucccuuauugucccuuc

SEQ ID NO: 785 - RNA, 21 nt, Artificial Sequence
  Description of Artificial Sequence: Synthetic oligonucleotide
aaauucccuuauugucccuuc

SEQ ID NO: 786 - RNA, 21 nt, Artificial Sequence
  Description of Artificial Sequence: Synthetic oligonucleotide
aauucccuuauugucccuucc

SEQ ID NO: 787 - RNA, 21 nt, Artificial Sequence
  Description of Artificial Sequence: Synthetic oligonucleotide
aauucccuuauugucccuucc

SEQ ID NO: 788 - RNA, 21 nt, Artificial Sequence
  Description of Artificial Sequence: Synthetic oligonucleotide
auucccuuauugucccuucca

SEQ ID NO: 789 - RNA, 21 nt, Artificial Sequence
  Description of Artificial Sequence: Synthetic oligonucleotide
auucccuuauugucccuucca

SEQ ID NO: 790 - RNA, 21 nt, Artificial Sequence
  Description of Artificial Sequence: Synthetic oligonucleotide
uucccuuauugucccuuccaa

SEQ ID NO: 791 - RNA, 21 nt, Artificial Sequence
  Description of Artificial Sequence: Synthetic oligonucleotide
uucccuuauugucccuuccaa

SEQ ID NO: 792 - RNA, 21 nt, Artificial Sequence
  Description of Artificial Sequence: Synthetic oligonucleotide
ucccuuauugucccuuccaaa

SEQ ID NO: 793 - RNA, 21 nt, Artificial Sequence
  Description of Artificial Sequence: Synthetic oligonucleotide
ucccuuauugucccuuccaaa

SEQ ID NO: 794 - RNA, 21 nt, Artificial Sequence
  Description of Artificial Sequence: Synthetic oligonucleotide
cccuuauugucccuuccaaaa

SEQ ID NO: 795 - RNA, 21 nt, Artificial Sequence
  Description of Artificial Sequence: Synthetic oligonucleotide
cccuuauugucccuuccaaaa

SEQ ID NO: 796 - RNA, 21 nt, Artificial Sequence
  Description of Artificial Sequence: Synthetic oligonucleotide
ccuuauugucccuuccaaaaa

SEQ ID NO: 797 - RNA, 21 nt, Artificial Sequence
  Description of Artificial Sequence: Synthetic oligonucleotide
ccuuauugucccuuccaaaaa

SEQ ID NO: 798 - RNA, 21 nt, Artificial Sequence
  Description of Artificial Sequence: Synthetic oligonucleotide
cuuauugucccuuccaaaaaa

SEQ ID NO: 799 - RNA, 21 nt, Artificial Sequence
  Description of Artificial Sequence: Synthetic oligonucleotide
cuuauugucccuuccaaaaaa

SEQ ID NO: 800 - RNA, 21 nt, Artificial Sequence
  Description of Artificial Sequence: Synthetic oligonucleotide
uuauugucccuuccaaaaaaa

SEQ ID NO: 801 - RNA, 21 nt, Artificial Sequence
  Description of Artificial Sequence: Synthetic oligonucleotide
uuauugucccuuccaaaaaaa

SEQ ID NO: 802 - RNA, 21 nt, Artificial Sequence
  Description of Artificial Sequence: Synthetic oligonucleotide
uauugucccuuccaaaaaaaa

SEQ ID NO: 803 - RNA, 21 nt, Artificial Sequence
  Description of Artificial Sequence: Synthetic oligonucleotide
uauugucccuuccaaaaaaaa

SEQ ID NO: 804 - RNA, 21 nt, Artificial Sequence
  Description of Artificial Sequence: Synthetic oligonucleotide
auugucccuuccaaaaaaaag

SEQ ID NO: 805 - RNA, 21 nt, Artificial Sequence
  Description of Artificial Sequence: Synthetic oligonucleotide
auugucccuuccaaaaaaaag

SEQ ID NO: 806 - RNA, 21 nt, Artificial Sequence
  Description of Artificial Sequence: Synthetic oligonucleotide
uugucccuuccaaaaaaaaga

SEQ ID NO: 807 - RNA, 21 nt, Artificial Sequence
  Description of Artificial Sequence: Synthetic oligonucleotide
uugucccuuccaaaaaaaaga

SEQ ID NO: 808 - RNA, 21 nt, Artificial Sequence
  Description of Artificial Sequence: Synthetic oligonucleotide
ugucccuuccaaaaaaaagag

SEQ ID NO: 809 - RNA, 21 nt, Artificial Sequence
  Description of Artificial Sequence: Synthetic oligonucleotide
ugucccuuccaaaaaaaagag

SEQ ID NO: 810 - RNA, 21 nt, Artificial Sequence
  Description of Artificial Sequence: Synthetic oligonucleotide
gucccuuccaaaaaaaagaga

SEQ ID NO: 811 - RNA, 21 nt, Artificial Sequence
  Description of Artificial Sequence: Synthetic oligonucleotide
gucccuuccaaaaaaaagaga

SEQ ID NO: 812 - RNA, 21 nt, Artificial Sequence
  Description of Artificial Sequence: Synthetic oligonucleotide
ucccuuccaaaaaaaagagaa

SEQ ID NO: 813 - RNA, 21 nt, Artificial Sequence
  Description of Artificial Sequence: Synthetic oligonucleotide
ucccuuccaaaaaaaagagaa

SEQ ID NO: 814 - RNA, 21 nt, Artificial Sequence
  Description of Artificial Sequence: Synthetic oligonucleotide
cccuuccaaaaaaaagagaau

SEQ ID NO: 815 - RNA, 21 nt, Artificial Sequence
  Description of Artificial Sequence: Synthetic oligonucleotide
cccuuccaaaaaaaagagaau

SEQ ID NO: 816 - RNA, 21 nt, Artificial Sequence
  Description of Artificial Sequence: Synthetic oligonucleotide
ccuuccaaaaaaaagagaauc

SEQ ID NO: 817 - RNA, 21 nt, Artificial Sequence
  Description of Artificial Sequence: Synthetic oligonucleotide
ccuuccaaaaaaaagagaauc

SEQ ID NO: 818 - RNA, 21 nt, Artificial Sequence
  Description of Artificial Sequence: Synthetic oligonucleotide
cuuccaaaaaaaagagaauca

SEQ ID NO: 819 - RNA, 21 nt, Artificial Sequence
  Description of Artificial Sequence: Synthetic oligonucleotide
cuuccaaaaaaaagagaauca

SEQ ID NO: 820 - RNA, 21 nt, Artificial Sequence
  Description of Artificial Sequence: Synthetic oligonucleotide
uuccaaaaaaaagagaaucaa

SEQ ID NO: 821 - RNA, 21 nt, Artificial Sequence
  Description of Artificial Sequence: Synthetic oligonucleotide
uuccaaaaaaaagagaaucaa

SEQ ID NO: 822 - RNA, 21 nt, Artificial Sequence
  Description of Artificial Sequence: Synthetic oligonucleotide
uccaaaaaaaagagaaucaaa

SEQ ID NO: 823 - RNA, 21 nt, Artificial Sequence
  Description of Artificial Sequence: Synthetic oligonucleotide
uccaaaaaaaagagaaucaaa

SEQ ID NO: 824 - RNA, 21 nt, Artificial Sequence
  Description of Artificial Sequence: Synthetic oligonucleotide
ccaaaaaaaagagaaucaaaa

SEQ ID NO: 825 - RNA, 21 nt, Artificial Sequence
  Description of Artificial Sequence: Synthetic oligonucleotide
ccaaaaaaaagagaaucaaaa

SEQ ID NO: 826 - RNA, 21 nt, Artificial Sequence
  Description of Artificial Sequence: Synthetic oligonucleotide
caaaaaaaagagaaucaaaau

SEQ ID NO: 827 - RNA, 21 nt, Artificial Sequence
  Description of Artificial Sequence: Synthetic oligonucleotide
caaaaaaaagagaaucaaaau

SEQ ID NO: 828 - RNA, 21 nt, Artificial Sequence
  Description of Artificial Sequence: Synthetic oligonucleotide
aaaaaaaagagaaucaaaauu

SEQ ID NO: 829 - RNA, 21 nt, Artificial Sequence
  Description of Artificial Sequence: Synthetic oligonucleotide
aaaaaaaagagaaucaaaauu

SEQ ID NO: 830 - RNA, 21 nt, Artificial Sequence
  Description of Artificial Sequence: Synthetic oligonucleotide
aaaaaaagagaaucaaaauuu

SEQ ID NO: 831 - RNA, 21 nt, Artificial Sequence
  Description of Artificial Sequence: Synthetic oligonucleotide
aaaaaaagagaaucaaaauuu

SEQ ID NO: 832 - RNA, 21 nt, Artificial Sequence
  Description of Artificial Sequence: Synthetic oligonucleotide
aaaaaagagaaucaaaauuuu

SEQ ID NO: 833 - RNA, 21 nt, Artificial Sequence
  Description of Artificial Sequence: Synthetic oligonucleotide
aaaaaagagaaucaaaauuuu

SEQ ID NO: 834 - RNA, 21 nt, Artificial Sequence
  Description of Artificial Sequence: Synthetic oligonucleotide
aaaaagagaaucaaaauuuua

SEQ ID NO: 835 - RNA, 21 nt, Artificial Sequence
  Description of Artificial Sequence: Synthetic oligonucleotide
aaaaagagaaucaaaauuuua

SEQ ID NO: 836 - RNA, 21 nt, Artificial Sequence
  Description of Artificial Sequence: Synthetic oligonucleotide
aaaagagaaucaaaauuuuac

SEQ ID NO: 837 - RNA, 21 nt, Artificial Sequence
  Description of Artificial Sequence: Synthetic oligonucleotide
aaaagagaaucaaaauuuuac

SEQ ID NO: 838 - RNA, 21 nt, Artificial Sequence
  Description of Artificial Sequence: Synthetic oligonucleotide
aaagagaaucaaaauuuuaca

SEQ ID NO: 839 - RNA, 21 nt, Artificial Sequence
  Description of Artificial Sequence: Synthetic oligonucleotide
aaagagaaucaaaauuuuaca

SEQ ID NO: 840 - RNA, 21 nt, Artificial Sequence
  Description of Artificial Sequence: Synthetic oligonucleotide
aagagaaucaaaauuuuacaa

SEQ ID NO: 841 - RNA, 21 nt, Artificial Sequence
  Description of Artificial Sequence: Synthetic oligonucleotide
aagagaaucaaaauuuuacaa

SEQ ID NO: 842 - RNA, 21 nt, Artificial Sequence
  Description of Artificial Sequence: Synthetic oligonucleotide
agagaaucaaaauuuuacaaa

SEQ ID NO: 843 - RNA, 21 nt, Artificial Sequence
  Description of Artificial Sequence: Synthetic oligonucleotide
agagaaucaaaauuuuacaaa

SEQ ID NO: 844 - RNA, 21 nt, Artificial Sequence
  Description of Artificial Sequence: Synthetic oligonucleotide
gagaaucaaaauuuuacaaag

SEQ ID NO: 845 - RNA, 21 nt, Artificial Sequence
  Description of Artificial Sequence: Synthetic oligonucleotide
gagaaucaaaauuuuacaaag

SEQ ID NO: 846 - RNA, 21 nt, Artificial Sequence
  Description of Artificial Sequence: Synthetic oligonucleotide
agaaucaaaauuuuacaaaga

SEQ ID NO: 847 - RNA, 21 nt, Artificial Sequence
  Description of Artificial Sequence: Synthetic oligonucleotide
agaaucaaaauuuuacaaaga

SEQ ID NO: 848 - RNA, 21 nt, Artificial Sequence
  Description of Artificial Sequence: Synthetic oligonucleotide
gaaucaaaauuuuacaaagaa

SEQ ID NO: 849 - RNA, 21 nt, Artificial Sequence
  Description of Artificial Sequence: Synthetic oligonucleotide
gaaucaaaauuuuacaaagaa

SEQ ID NO: 850 - RNA, 21 nt, Artificial Sequence
  Description of Artificial Sequence: Synthetic oligonucleotide
aaucaaaauuuuacaaagaau

SEQ ID NO: 851 - RNA, 21 nt, Artificial Sequence
  Description of Artificial Sequence: Synthetic oligonucleotide
aaucaaaauuuuacaaagaau

SEQ ID NO: 852 - RNA, 21 nt, Artificial Sequence
  Description of Artificial Sequence: Synthetic oligonucleotide
aucaaaauuuuacaaagaauc

SEQ ID NO: 853 - RNA, 21 nt, Artificial Sequence
  Description of Artificial Sequence: Synthetic oligonucleotide
aucaaaauuuuacaaagaauc

SEQ ID NO: 854 - RNA, 21 nt, Artificial Sequence
  Description of Artificial Sequence: Synthetic oligonucleotide
ucaaaauuuuacaaagaauca

SEQ ID NO: 855 - RNA, 21 nt, Artificial Sequence
  Description of Artificial Sequence: Synthetic oligonucleotide
ucaaaauuuuacaaagaauca

SEQ ID NO: 856 - RNA, 21 nt, Artificial Sequence
  Description of Artificial Sequence: Synthetic oligonucleotide
caaaauuuuacaaagaaucaa

SEQ ID NO: 857 - RNA, 21 nt, Artificial Sequence
  Description of Artificial Sequence: Synthetic oligonucleotide
caaaauuuuacaaagaaucaa

SEQ ID NO: 858 - RNA, 21 nt, Artificial Sequence
  Description of Artificial Sequence: Synthetic oligonucleotide
aaaauuuuacaaagaaucaaa

SEQ ID NO: 859 - RNA, 21 nt, Artificial Sequence
  Description of Artificial Sequence: Synthetic oligonucleotide
aaaauuuuacaaagaaucaaa

SEQ ID NO: 860 - RNA, 21 nt, Artificial Sequence
  Description of Artificial Sequence: Synthetic oligonucleotide
aaauuuuacaaagaaucaaag

SEQ ID NO: 861 - RNA, 21 nt, Artificial Sequence
  Description of Artificial Sequence: Synthetic oligonucleotide
aaauuuuacaaagaaucaaag

SEQ ID NO: 862 - RNA, 21 nt, Artificial Sequence
  Description of Artificial Sequence: Synthetic oligonucleotide
aauuuuacaaagaaucaaagg

SEQ ID NO: 863 - RNA, 21 nt, Artificial Sequence
  Description of Artificial Sequence: Synthetic oligonucleotide
aauuuuacaaagaaucaaagg

SEQ ID NO: 864 - RNA, 21 nt, Artificial Sequence
  Description of Artificial Sequence: Synthetic oligonucleotide
auuuuacaaagaaucaaagga

SEQ ID NO: 865 - RNA, 21 nt, Artificial Sequence
  Description of Artificial Sequence: Synthetic oligonucleotide
auuuuacaaagaaucaaagga

SEQ ID NO: 866 - RNA, 21 nt, Artificial Sequence
  Description of Artificial Sequence: Synthetic oligonucleotide
uuuuacaaagaaucaaaggaa

SEQ ID NO: 867 - RNA, 21 nt, Artificial Sequence
  Description of Artificial Sequence: Synthetic oligonucleotide
uuuuacaaagaaucaaaggaa

SEQ ID NO: 868 - RNA, 21 nt, Artificial Sequence
  Description of Artificial Sequence: Synthetic oligonucleotide
uuuacaaagaaucaaaggaau

SEQ ID NO: 869 - RNA, 21 nt, Artificial Sequence
  Description of Artificial Sequence: Synthetic oligonucleotide
uuuacaaagaaucaaaggaau

SEQ ID NO: 870 - RNA, 21 nt, Artificial Sequence
  Description of Artificial Sequence: Synthetic oligonucleotide
uuacaaagaaucaaaggaauu

SEQ ID NO: 871 - RNA, 21 nt, Artificial Sequence
  Description of Artificial Sequence: Synthetic oligonucleotide
uuacaaagaaucaaaggaauu

SEQ ID NO: 872 - RNA, 21 nt, Artificial Sequence
  Description of Artificial Sequence: Synthetic oligonucleotide
uacaaagaaucaaaggaauuc

SEQ ID NO: 873 - RNA, 21 nt, Artificial Sequence
  Description of Artificial Sequence: Synthetic oligonucleotide
uacaaagaaucaaaggaauuc

SEQ ID NO: 874 - RNA, 21 nt, Artificial Sequence
  Description of Artificial Sequence: Synthetic oligonucleotide
acaaagaaucaaaggaauucu

SEQ ID NO: 875 - RNA, 21 nt, Artificial Sequence
  Description of Artificial Sequence: Synthetic oligonucleotide
acaaagaaucaaaggaauucu

SEQ ID NO: 876 - RNA, 21 nt, Artificial Sequence
  Description of Artificial Sequence: Synthetic oligonucleotide
caaagaaucaaaggaauucua

SEQ ID NO: 877 - RNA, 21 nt, Artificial Sequence
  Description of Artificial Sequence: Synthetic oligonucleotide
caaagaaucaaaggaauucua

SEQ ID NO: 878 - RNA, 21 nt, Artificial Sequence
  Description of Artificial Sequence: Synthetic oligonucleotide
aaagaaucaaaggaauucuag

SEQ ID NO: 879 - RNA, 21 nt, Artificial Sequence
  Description of Artificial Sequence: Synthetic oligonucleotide
aaagaaucaaaggaauucuag

SEQ ID NO: 880 - RNA, 21 nt, Artificial Sequence
  Description of Artificial Sequence: Synthetic oligonucleotide
aagaaucaaaggaauucuaga

SEQ ID NO: 881 - RNA, 21 nt, Artificial Sequence
  Description of Artificial Sequence: Synthetic oligonucleotide
aagaaucaaaggaauucuaga

SEQ ID NO: 882 - RNA, 21 nt, Artificial Sequence
  Description of Artificial Sequence: Synthetic oligonucleotide
agaaucaaaggaauucuagaa

SEQ ID NO: 883 - RNA, 21 nt, Artificial Sequence
  Description of Artificial Sequence: Synthetic oligonucleotide
agaaucaaaggaauucuagaa

SEQ ID NO: 884 - RNA, 21 nt, Artificial Sequence
  Description of Artificial Sequence: Synthetic oligonucleotide
gaaucaaaggaauucuagaaa

SEQ ID NO: 885 - RNA, 21 nt, Artificial Sequence
  Description of Artificial Sequence: Synthetic oligonucleotide
gaaucaaaggaauucuagaaa

SEQ ID NO: 886 - RNA, 21 nt, Artificial Sequence
  Description of Artificial Sequence: Synthetic oligonucleotide
aaucaaaggaauucuagaaag

SEQ ID NO: 887 - RNA, 21 nt, Artificial Sequence
  Description of Artificial Sequence: Synthetic oligonucleotide
aaucaaaggaauucuagaaag

SEQ ID NO: 888 - RNA, 21 nt, Artificial Sequence
  Description of Artificial Sequence: Synthetic oligonucleotide
aucaaaggaauucuagaaagu

SEQ ID NO: 889 - RNA, 21 nt, Artificial Sequence
  Description of Artificial Sequence: Synthetic oligonucleotide
aucaaaggaauucuagaaagu

SEQ ID NO: 890 - RNA, 21 nt, Artificial Sequence
  Description of Artificial Sequence: Synthetic oligonucleotide
ucaaaggaauucuagaaagua

SEQ ID NO: 891 - RNA, 21 nt, Artificial Sequence
  Description of Artificial Sequence: Synthetic oligonucleotide
ucaaaggaauucuagaaagua

SEQ ID NO: 892 - RNA, 21 nt, Artificial Sequence
  Description of Artificial Sequence: Synthetic oligonucleotide
caaaggaauucuagaaaguau

SEQ ID NO: 893 - RNA, 21 nt, Artificial Sequence
  Description of Artificial Sequence: Synthetic oligonucleotide
caaaggaauucuagaaaguau

SEQ ID NO: 894 - RNA, 21 nt, Artificial Sequence
  Description of Artificial Sequence: Synthetic oligonucleotide
aaaggaauucuagaaaguauc

SEQ ID NO: 895 - RNA, 21 nt, Artificial Sequence
  Description of Artificial Sequence: Synthetic oligonucleotide
aaaggaauucuagaaaguauc

SEQ ID NO: 896 - RNA, 21 nt, Artificial Sequence
  Description of Artificial Sequence: Synthetic oligonucleotide
aaggaauucuagaaaguaucu

SEQ ID NO: 897 - RNA, 21 nt, Artificial Sequence
  Description of Artificial Sequence: Synthetic oligonucleotide
aaggaauucuagaaaguaucu

SEQ ID NO: 898 - RNA, 21 nt, Artificial Sequence
  Description of Artificial Sequence: Synthetic oligonucleotide
aggaauucuagaaaguaucug

SEQ ID NO: 899 - RNA, 21 nt, Artificial Sequence
  Description of Artificial Sequence: Synthetic oligonucleotide
aggaauucuagaaaguaucug

SEQ ID NO: 900 - RNA, 21 nt, Artificial Sequence
  Description of Artificial Sequence: Synthetic oligonucleotide
ggaauucuagaaaguaucugg

SEQ ID NO: 901 - RNA, 21 nt, Artificial Sequence
  Description of Artificial Sequence: Synthetic oligonucleotide
ggaauucuagaaaguaucugg

SEQ ID NO: 902 - RNA, 21 nt, Artificial Sequence
  Description of Artificial Sequence: Synthetic oligonucleotide
gaauucuagaaaguaucuggg

SEQ ID NO: 903 - RNA, 21 nt, Artificial Sequence
  Description of Artificial Sequence: Synthetic oligonucleotide
gaauucuagaaaguaucuggg

SEQ ID NO: 904 - RNA, 21 nt, Artificial Sequence
  Description of Artificial Sequence: Synthetic oligonucleotide
aauucuagaaaguaucugggc

SEQ ID NO: 905 - RNA, 21 nt, Artificial Sequence
  Description of Artificial Sequence: Synthetic oligonucleotide
aauucuagaaaguaucugggc

SEQ ID NO: 906 - RNA, 21 nt, Artificial Sequence
  Description of Artificial Sequence: Synthetic oligonucleotide
auucuagaaaguaucugggca

SEQ ID NO: 907 - RNA, 21 nt, Artificial Sequence
  Description of Artificial Sequence: Synthetic oligonucleotide
auucuagaaaguaucugggca

SEQ ID NO: 908 - RNA, 21 nt, Artificial Sequence
  Description of Artificial Sequence: Synthetic oligonucleotide
uucuagaaaguaucugggcag

SEQ ID NO: 909 - RNA, 21 nt, Artificial Sequence
  Description of Artificial Sequence: Synthetic oligonucleotide
uucuagaaaguaucugggcag

SEQ ID NO: 910 - RNA, 21 nt, Artificial Sequence
  Description of Artificial Sequence: Synthetic oligonucleotide
ucuagaaaguaucugggcaga

SEQ ID NO: 911 - RNA, 21 nt, Artificial Sequence
  Description of Artificial Sequence: Synthetic oligonucleotide
ucuagaaaguaucugggcaga

SEQ ID NO: 912 - RNA, 21 nt, Artificial Sequence
  Description of Artificial Sequence: Synthetic oligonucleotide
cuagaaaguaucugggcagaa

SEQ ID NO: 913 - RNA, 21 nt, Artificial Sequence
  Description of Artificial Sequence: Synthetic oligonucleotide
cuagaaaguaucugggcagaa

SEQ ID NO: 914 - RNA, 21 nt, Artificial Sequence
  Description of Artificial Sequence: Synthetic oligonucleotide
uagaaaguaucugggcagaac

SEQ ID NO: 915 - RNA, 21 nt, Artificial Sequence
  Description of Artificial Sequence: Synthetic oligonucleotide
uagaaaguaucugggcagaac

SEQ ID NO: 916 - RNA, 21 nt, Artificial Sequence
  Description of Artificial Sequence: Synthetic oligonucleotide
agaaaguaucugggcagaacg

SEQ ID NO: 917 - RNA, 21 nt, Artificial Sequence
  Description of Artificial Sequence: Synthetic oligonucleotide
agaaaguaucugggcagaacg

SEQ ID NO: 918 - RNA, 21 nt, Artificial Sequence
  Description of Artificial Sequence: Synthetic oligonucleotide
gaaaguaucugggcagaacgc

SEQ ID NO: 919 - RNA, 21 nt, Artificial Sequence
  Description of Artificial Sequence: Synthetic oligonucleotide
gaaaguaucugggcagaacgc

SEQ ID NO: 920 - RNA, 21 nt, Artificial Sequence
  Description of Artificial Sequence: Synthetic oligonucleotide
aaaguaucugggcagaacgcu

SEQ ID NO: 921 - RNA, 21 nt, Artificial Sequence
  Description of Artificial Sequence: Synthetic oligonucleotide
aaaguaucugggcagaacgcu

SEQ ID NO: 922 - RNA, 21 nt, Artificial Sequence
  Description of Artificial Sequence: Synthetic oligonucleotide
aaguaucugggcagaacgcua

SEQ ID NO: 923 - RNA, 21 nt, Artificial Sequence
  Description of Artificial Sequence: Synthetic oligonucleotide
aaguaucugggcagaacgcua

SEQ ID NO: 924 - RNA, 21 nt, Artificial Sequence
  Description of Artificial Sequence: Synthetic oligonucleotide
aguaucugggcagaacgcuag

SEQ ID NO: 925 - RNA, 21 nt, Artificial Sequence
  Description of Artificial Sequence: Synthetic oligonucleotide
aguaucugggcagaacgcuag

SEQ ID NO: 926 - RNA, 21 nt, Artificial Sequence
  Description of Artificial Sequence: Synthetic oligonucleotide
guaucugggcagaacgcuagg

SEQ ID NO: 927 - RNA, 21 nt, Artificial Sequence
  Description of Artificial Sequence: Synthetic oligonucleotide
guaucugggcagaacgcuagg

SEQ ID NO: 928 - RNA, 21 nt, Artificial Sequence
  Description of Artificial Sequence: Synthetic oligonucleotide
uaucugggcagaacgcuagga

SEQ ID NO: 929 - RNA, 21 nt, Artificial Sequence
  Description of Artificial Sequence: Synthetic oligonucleotide
uaucugggcagaacgcuagga

SEQ ID NO: 930 - RNA, 21 nt, Artificial Sequence
  Description of Artificial Sequence: Synthetic oligonucleotide
aucugggcagaacgcuaggag

SEQ ID NO: 931 - RNA, 21 nt, Artificial Sequence
  Description of Artificial Sequence: Synthetic oligonucleotide
aucugggcagaacgcuaggag

SEQ ID NO: 932 - RNA, 21 nt, Artificial Sequence
  Description of Artificial Sequence: Synthetic oligonucleotide
ucugggcagaacgcuaggaga

SEQ ID NO: 933 - RNA, 21 nt, Artificial Sequence
  Description of Artificial Sequence: Synthetic oligonucleotide
ucugggcagaacgcuaggaga

SEQ ID NO: 934 - RNA, 21 nt, Artificial Sequence
  Description of Artificial Sequence: Synthetic oligonucleotide
cugggcagaacgcuaggagag

SEQ ID NO: 935 - RNA, 21 nt, Artificial Sequence
  Description of Artificial Sequence: Synthetic oligonucleotide
cugggcagaacgcuaggagag

SEQ ID NO: 936 - RNA, 21 nt, Artificial Sequence
  Description of Artificial Sequence: Synthetic oligonucleotide
ugggcagaacgcuaggagaga

SEQ ID NO: 937 - RNA, 21 nt, Artificial Sequence
  Description of Artificial Sequence: Synthetic oligonucleotide
ugggcagaacgcuaggagaga

SEQ ID NO: 938 - RNA, 21 nt, Artificial Sequence
  Description of Artificial Sequence: Synthetic oligonucleotide
gggcagaacgcuaggagagau

SEQ ID NO: 939 - RNA, 21 nt, Artificial Sequence
  Description of Artificial Sequence: Synthetic oligonucleotide
gggcagaacgcuaggagagau

SEQ ID NO: 940 - RNA, 21 nt, Artificial Sequence
  Description of Artificial Sequence: Synthetic oligonucleotide
ggcagaacgcuaggagagauc

SEQ ID NO: 941 - RNA, 21 nt, Artificial Sequence
  Description of Artificial Sequence: Synthetic oligonucleotide
ggcagaacgcuaggagagauc

SEQ ID NO: 942 - RNA, 21 nt, Artificial Sequence
  Description of Artificial Sequence: Synthetic oligonucleotide
gcagaacgcuaggagagaucc

SEQ ID NO: 943 - RNA, 21 nt, Artificial Sequence
  Description of Artificial Sequence: Synthetic oligonucleotide
gcagaacgcuaggagagaucc

SEQ ID NO: 944 - RNA, 21 nt, Artificial Sequence
  Description of Artificial Sequence: Synthetic oligonucleotide
cagaacgcuaggagagaucca

SEQ ID NO: 945 - RNA, 21 nt, Artificial Sequence
  Description of Artificial Sequence: Synthetic oligonucleotide
cagaacgcuaggagagaucca

SEQ ID NO: 946 - RNA, 21 nt, Artificial Sequence
  Description of Artificial Sequence: Synthetic oligonucleotide
agaacgcuaggagagauccaa

SEQ ID NO: 947 - RNA, 21 nt, Artificial Sequence
  Description of Artificial Sequence: Synthetic oligonucleotide
agaacgcuaggagagauccaa

SEQ ID NO: 948 - RNA, 21 nt, Artificial Sequence
  Description of Artificial Sequence: Synthetic oligonucleotide
gaacgcuaggagagauccaaa

SEQ ID NO: 949 - RNA, 21 nt, Artificial Sequence
  Description of Artificial Sequence: Synthetic oligonucleotide
gaacgcuaggagagauccaaa

SEQ ID NO: 950 - RNA, 21 nt, Artificial Sequence
  Description of Artificial Sequence: Synthetic oligonucleotide
aacgcuaggagagauccaaau

SEQ ID NO: 951 - RNA, 21 nt, Artificial Sequence
  Description of Artificial Sequence: Synthetic oligonucleotide
aacgcuaggagagauccaaau

SEQ ID NO: 952 - RNA, 21 nt, Artificial Sequence
  Description of Artificial Sequence: Synthetic oligonucleotide
acgcuaggagagauccaaauu

SEQ ID NO: 953 - RNA, 21 nt, Artificial Sequence
  Description of Artificial Sequence: Synthetic oligonucleotide
acgcuaggagagauccaaauu

SEQ ID NO: 954 - RNA, 21 nt, Artificial Sequence
  Description of Artificial Sequence: Synthetic oligonucleotide
cgcuaggagagauccaaauuu

SEQ ID NO: 955 - RNA, 21 nt, Artificial Sequence
  Description of Artificial Sequence: Synthetic oligonucleotide
cgcuaggagagauccaaauuu

SEQ ID NO: 956 - RNA, 21 nt, Artificial Sequence
  Description of Artificial Sequence: Synthetic oligonucleotide
gcuaggagagauccaaauuuc

SEQ ID NO: 957 - RNA, 21 nt, Artificial Sequence
  Description of Artificial Sequence: Synthetic oligonucleotide
gcuaggagagauccaaauuuc

SEQ ID NO: 958 - RNA, 21 nt, Artificial Sequence
  Description of Artificial Sequence: Synthetic oligonucleotide
cuaggagagauccaaauuucc

SEQ ID NO: 959 - RNA, 21 nt, Artificial Sequence
  Description of Artificial Sequence: Synthetic oligonucleotide
cuaggagagauccaaauuucc

SEQ ID NO: 960 - RNA, 21 nt, Artificial Sequence
  Description of Artificial Sequence: Synthetic oligonucleotide
uaggagagauccaaauuucca

SEQ ID NO: 961 - RNA, 21 nt, Artificial Sequence
  Description of Artificial Sequence: Synthetic oligonucleotide
uaggagagauccaaauuucca

SEQ ID NO: 962 - RNA, 21 nt, Artificial Sequence
  Description of Artificial Sequence: Synthetic oligonucleotide
aggagagauccaaauuuccau

SEQ ID NO: 963 - RNA, 21 nt, Artificial Sequence
  Description of Artificial Sequence: Synthetic oligonucleotide
aggagagauccaaauuuccau

SEQ ID NO: 964 - RNA, 21 nt, Artificial Sequence
  Description of Artificial Sequence: Synthetic oligonucleotide
ggagagauccaaauuuccauu

SEQ ID NO: 965 - RNA, 21 nt, Artificial Sequence
  Description of Artificial Sequence: Synthetic oligonucleotide
ggagagauccaaauuuccauu

SEQ ID NO: 966 - RNA, 21 nt, Artificial Sequence
  Description of Artificial Sequence: Synthetic oligonucleotide
gagagauccaaauuuccauug

SEQ ID NO: 967 - RNA, 21 nt, Artificial Sequence
  Description of Artificial Sequence: Synthetic oligonucleotide
gagagauccaaauuuccauug

SEQ ID NO: 968 - RNA, 21 nt, Artificial Sequence
  Description of Artificial Sequence: Synthetic oligonucleotide
agagauccaaauuuccauugu

SEQ ID NO: 969 - RNA, 21 nt, Artificial Sequence
  Description of Artificial Sequence: Synthetic oligonucleotide
agagauccaaauuuccauugu

SEQ ID NO: 970 - RNA, 21 nt, Artificial Sequence
  Description of Artificial Sequence: Synthetic oligonucleotide
gagauccaaauuuccauuguc

SEQ ID NO: 971 - RNA, 21 nt, Artificial Sequence
  Description of Artificial Sequence: Synthetic oligonucleotide
gagauccaaauuuccauuguc

SEQ ID NO: 972 - RNA, 21 nt, Artificial Sequence
  Description of Artificial Sequence: Synthetic oligonucleotide
agauccaaauuuccauugucu

SEQ ID NO: 973 - RNA, 21 nt, Artificial Sequence
  Description of Artificial Sequence: Synthetic oligonucleotide
agauccaaauuuccauugucu

SEQ ID NO: 974 - RNA, 21 nt, Artificial Sequence
  Description of Artificial Sequence: Synthetic oligonucleotide
gauccaaauuuccauugucuu

SEQ ID NO: 975 - RNA, 21 nt, Artificial Sequence
  Description of Artificial Sequence: Synthetic oligonucleotide
gauccaaauuuccauugucuu

SEQ ID NO: 976 - RNA, 21 nt, Artificial Sequence
  Description of Artificial Sequence: Synthetic oligonucleotide
auccaaauuuccauugucuug

SEQ ID NO: 977 - RNA, 21 nt, Artificial Sequence
  Description of Artificial Sequence: Synthetic oligonucleotide
auccaaauuuccauugucuug

SEQ ID NO: 978 - RNA, 21 nt, Artificial Sequence
  Description of Artificial Sequence: Synthetic oligonucleotide
uccaaauuuccauugucuugc

SEQ ID NO: 979 - RNA, 21 nt, Artificial Sequence
  Description of Artificial Sequence: Synthetic oligonucleotide
uccaaauuuccauugucuugc

SEQ ID NO: 980 - RNA, 21 nt, Artificial Sequence
  Description of Artificial Sequence: Synthetic oligonucleotide
ccaaauuuccauugucuugca

SEQ ID NO: 981 - RNA, 21 nt, Artificial Sequence
  Description of Artificial Sequence: Synthetic oligonucleotide
ccaaauuuccauugucuugca

SEQ ID NO: 982 - RNA, 21 nt, Artificial Sequence
  Description of Artificial Sequence: Synthetic oligonucleotide
caaauuuccauugucuugcaa

SEQ ID NO: 983 - RNA, 21 nt, Artificial Sequence
  Description of Artificial Sequence: Synthetic oligonucleotide
caaauuuccauugucuugcaa

SEQ ID NO: 984 - RNA, 21 nt, Artificial Sequence
  Description of Artificial Sequence: Synthetic oligonucleotide
aaauuuccauugucuugcaag

SEQ ID NO: 985 - RNA, 21 nt, Artificial Sequence
  Description of Artificial Sequence: Synthetic oligonucleotide
aaauuuccauugucuugcaag

SEQ ID NO: 986 - RNA, 21 nt, Artificial Sequence
  Description of Artificial Sequence: Synthetic oligonucleotide
aauuuccauugucuugcaagc

SEQ ID NO: 987 - RNA, 21 nt, Artificial Sequence
  Description of Artificial Sequence: Synthetic oligonucleotide
aauuuccauugucuugcaagc

SEQ ID NO: 988 - RNA, 21 nt, Artificial Sequence
  Description of Artificial Sequence: Synthetic oligonucleotide
auuuccauugucuugcaagca

SEQ ID NO: 989 - RNA, 21 nt, Artificial Sequence
  Description of Artificial Sequence: Synthetic oligonucleotide
auuuccauugucuugcaagca

SEQ ID NO: 990 - RNA, 21 nt, Artificial Sequence
  Description of Artificial Sequence: Synthetic oligonucleotide
uuuccauugucuugcaagcaa

SEQ ID NO: 991 - RNA, 21 nt, Artificial Sequence
  Description of Artificial Sequence: Synthetic oligonucleotide
uuuccauugucuugcaagcaa

SEQ ID NO: 992 - RNA, 21 nt, Artificial Sequence
  Description of Artificial Sequence: Synthetic oligonucleotide
uuccauugucuugcaagcaaa

SEQ ID NO: 993 - RNA, 21 nt, Artificial Sequence
  Description of Artificial Sequence: Synthetic oligonucleotide
uuccauugucuugcaagcaaa

SEQ ID NO: 994 - RNA, 21 nt, Artificial Sequence
  Description of Artificial Sequence: Synthetic oligonucleotide
uccauugucuugcaagcaaag

SEQ ID NO: 995 - RNA, 21 nt, Artificial Sequence
  Description of Artificial Sequence: Synthetic oligonucleotide
uccauugucuugcaagcaaag

SEQ ID NO: 996 - RNA, 21 nt, Artificial Sequence
  Description of Artificial Sequence: Synthetic oligonucleotide
ccauugucuugcaagcaaagc

SEQ ID NO: 997 - RNA, 21 nt, Artificial Sequence
  Description of Artificial Sequence: Synthetic oligonucleotide
ccauugucuugcaagcaaagc

SEQ ID NO: 998 - RNA, 21 nt, Artificial Sequence
  Description of Artificial Sequence: Synthetic oligonucleotide
cauugucuugcaagcaaagca

SEQ ID NO: 999 - RNA, 21 nt, Artificial Sequence
  Description of Artificial Sequence: Synthetic oligonucleotide
cauugucuugcaagcaaagca

SEQ ID NO: 1000 - RNA, 21 nt, Artificial Sequence
  Description of Artificial Sequence: Synthetic oligonucleotide
auugucuugcaagcaaagcac

SEQ ID NO: 1001 - RNA, 21 nt, Artificial Sequence
  Description of Artificial Sequence: Synthetic oligonucleotide
auugucuugcaagcaaagcac

SEQ ID NO: 1002 - RNA, 21 nt, Artificial Sequence
  Description of Artificial Sequence: Synthetic oligonucleotide
uugucuugcaagcaaagcacg

SEQ ID NO: 1003 - RNA, 21 nt, Artificial Sequence
  Description of Artificial Sequence: Synthetic oligonucleotide
uugucuugcaagcaaagcacg

SEQ ID NO: 1004 - RNA, 21 nt, Artificial Sequence
  Description of Artificial Sequence: Synthetic oligonucleotide
ugucuugcaagcaaagcacgu

SEQ ID NO: 1005 - RNA, 21 nt, Artificial Sequence
  Description of Artificial Sequence: Synthetic oligonucleotide
ugucuugcaagcaaagcacgu

SEQ ID NO: 1006 - RNA, 21 nt, Artificial Sequence
  Description of Artificial Sequence: Synthetic oligonucleotide
gucuugcaagcaaagcacgua

SEQ ID NO: 1007 - RNA, 21 nt, Artificial Sequence
  Description of Artificial Sequence: Synthetic oligonucleotide
gucuugcaagcaaagcacgua

SEQ ID NO: 1008 - RNA, 21 nt, Artificial Sequence
  Description of Artificial Sequence: Synthetic oligonucleotide
ucuugcaagcaaagcacguau

SEQ ID NO: 1009 - RNA, 21 nt, Artificial Sequence
  Description of Artificial Sequence: Synthetic oligonucleotide
ucuugcaagcaaagcacguau

SEQ ID NO: 1010 - RNA, 21 nt, Artificial Sequence
  Description of Artificial Sequence: Synthetic oligonucleotide
cuugcaagcaaagcacguauu

SEQ ID NO: 1011 - RNA, 21 nt, Artificial Sequence
  Description of Artificial Sequence: Synthetic oligonucleotide
cuugcaagcaaagcacguauu

SEQ ID NO: 1012 - RNA, 21 nt, Artificial Sequence
  Description of Artificial Sequence: Synthetic oligonucleotide
uugcaagcaaagcacguauua

SEQ ID NO: 1013 - RNA, 21 nt, Artificial Sequence
  Description of Artificial Sequence: Synthetic oligonucleotide
uugcaagcaaagcacguauua

SEQ ID NO: 1014 - RNA, 21 nt, Artificial Sequence
  Description of Artificial Sequence: Synthetic oligonucleotide
ugcaagcaaagcacguauuaa

SEQ ID NO: 1015 - RNA, 21 nt, Artificial Sequence
  Description of Artificial Sequence: Synthetic oligonucleotide
ugcaagcaaagcacguauuaa

SEQ ID NO: 1016 - RNA, 21 nt, Artificial Sequence
  Description of Artificial Sequence: Synthetic oligonucleotide
gcaagcaaagcacguauuaaa

SEQ ID NO: 1017 - RNA, 21 nt, Artificial Sequence
  Description of Artificial Sequence: Synthetic oligonucleotide
gcaagcaaagcacguauuaaa

SEQ ID NO: 1018 - RNA, 21 nt, Artificial Sequence
  Description of Artificial Sequence: Synthetic oligonucleotide
caagcaaagcacguauuaaau

SEQ ID NO: 1019 - RNA, 21 nt, Artificial Sequence
  Description of Artificial Sequence: Synthetic oligonucleotide
caagcaaagcacguauuaaau

SEQ ID NO: 1020 - RNA, 21 nt, Artificial Sequence
  Description of Artificial Sequence: Synthetic oligonucleotide
aagcaaagcacguauuaaaua

SEQ ID NO: 1021 - RNA, 21 nt, Artificial Sequence
  Description of Artificial Sequence: Synthetic oligonucleotide
aagcaaagcacguauuaaaua

SEQ ID NO: 1022 - RNA, 21 nt, Artificial Sequence
  Description of Artificial Sequence: Synthetic oligonucleotide
agcaaagcacguauuaaauau

SEQ ID NO: 1023 - RNA, 21 nt, Artificial Sequence
  Description of Artificial Sequence: Synthetic oligonucleotide
agcaaagcacguauuaaauau

SEQ ID NO: 1024 - RNA, 21 nt, Artificial Sequence
  Description of Artificial Sequence: Synthetic oligonucleotide
gcaaagcacguauuaaauaug

SEQ ID NO: 1025 - RNA, 21 nt, Artificial Sequence
  Description of Artificial Sequence: Synthetic oligonucleotide
gcaaagcacguauuaaauaug

SEQ ID NO: 1026 - RNA, 21 nt, Artificial Sequence
  Description of Artificial Sequence: Synthetic oligonucleotide
caaagcacguauuaaauauga

SEQ ID NO: 1027 - RNA, 21 nt, Artificial Sequence
  Description of Artificial Sequence: Synthetic oligonucleotide
caaagcacguauuaaauauga

SEQ ID NO: 1028 - RNA, 21 nt, Artificial Sequence
  Description of Artificial Sequence: Synthetic oligonucleotide
aaagcacguauuaaauaugau

SEQ ID NO: 1029 - RNA, 21 nt, Artificial Sequence
  Description of Artificial Sequence: Synthetic oligonucleotide
aaagcacguauuaaauaugau

SEQ ID NO: 1030 - RNA, 21 nt, Artificial Sequence
  Description of Artificial Sequence: Synthetic oligonucleotide
aagcacguauuaaauaugauc

SEQ ID NO: 1031 - RNA, 21 nt, Artificial Sequence
  Description of Artificial Sequence: Synthetic oligonucleotide
aagcacguauuaaauaugauc

SEQ ID NO: 1032 - RNA, 21 nt, Artificial Sequence
  Description of Artificial Sequence: Synthetic oligonucleotide
agcacguauuaaauaugaucu

SEQ ID NO: 1033 - RNA, 21 nt, Artificial Sequence
  Description of Artificial Sequence: Synthetic oligonucleotide
agcacguauuaaauaugaucu

SEQ ID NO: 1034 - RNA, 21 nt, Artificial Sequence
  Description of Artificial Sequence: Synthetic oligonucleotide
gcacguauuaaauaugaucug

SEQ ID NO: 1035 - RNA, 21 nt, Artificial Sequence
  Description of Artificial Sequence: Synthetic oligonucleotide
gcacguauuaaauaugaucug

SEQ ID NO: 1036 - RNA, 21 nt, Artificial Sequence
  Description of Artificial Sequence: Synthetic oligonucleotide
cacguauuaaauaugaucugc

SEQ ID NO: 1037 - RNA, 21 nt, Artificial Sequence
  Description of Artificial Sequence: Synthetic oligonucleotide
cacguauuaaauaugaucugc

SEQ ID NO: 1038 - RNA, 21 nt, Artificial Sequence
  Description of Artificial Sequence: Synthetic oligonucleotide
acguauuaaauaugaucugca

SEQ ID NO: 1039 - RNA, 21 nt, Artificial Sequence
  Description of Artificial Sequence: Synthetic oligonucleotide
acguauuaaauaugaucugca

SEQ ID NO: 1040 - RNA, 21 nt, Artificial Sequence
  Description of Artificial Sequence: Synthetic oligonucleotide
cguauuaaauaugaucugcag

SEQ ID NO: 1041 - RNA, 21 nt, Artificial Sequence
  Description of Artificial Sequence: Synthetic oligonucleotide
cguauuaaauaugaucugcag

SEQ ID NO: 1042 - RNA, 21 nt, Artificial Sequence
  Description of Artificial Sequence: Synthetic oligonucleotide
guauuaaauaugaucugcagc

SEQ ID NO: 1043 - RNA, 21 nt, Artificial Sequence
  Description of Artificial Sequence: Synthetic oligonucleotide
guauuaaauaugaucugcagc

SEQ ID NO: 1044 - RNA, 21 nt, Artificial Sequence
  Description of Artificial Sequence: Synthetic oligonucleotide
uauuaaauaugaucugcagcc

SEQ ID NO: 1045 - RNA, 21 nt, Artificial Sequence
  Description of Artificial Sequence: Synthetic oligonucleotide
uauuaaauaugaucugcagcc

SEQ ID NO: 1046 - RNA, 21 nt, Artificial Sequence
  Description of Artificial Sequence: Synthetic oligonucleotide
auuaaauaugaucugcagcca

SEQ ID NO: 1047 - RNA, 21 nt, Artificial Sequence
  Description of Artificial Sequence: Synthetic oligonucleotide
auuaaauaugaucugcagcca

SEQ ID NO: 1048 - RNA, 21 nt, Artificial Sequence
  Description of Artificial Sequence: Synthetic oligonucleotide
uuaaauaugaucugcagccau

SEQ ID NO: 1049 - RNA, 21 nt, Artificial Sequence
  Description of Artificial Sequence: Synthetic oligonucleotide
uuaaauaugaucugcagccau

SEQ ID NO: 1050 - RNA, 21 nt, Artificial Sequence
  Description of Artificial Sequence: Synthetic oligonucleotide
uaaauaugaucugcagccauu

SEQ ID NO: 1051 - RNA, 21 nt, Artificial Sequence
  Description of Artificial Sequence: Synthetic oligonucleotide
uaaauaugaucugcagccauu

SEQ ID NO: 1052 - RNA, 21 nt, Artificial Sequence
  Description of Artificial Sequence: Synthetic oligonucleotide
aaauaugaucugcagccauua

SEQ ID NO: 1053 - RNA, 21 nt, Artificial Sequence
  Description of Artificial Sequence: Synthetic oligonucleotide
aaauaugaucugcagccauua

SEQ ID NO: 1054 - RNA, 21 nt, Artificial Sequence
  Description of Artificial Sequence: Synthetic oligonucleotide
aauaugaucugcagccauuaa

SEQ ID NO: 1055 - RNA, 21 nt, Artificial Sequence
  Description of Artificial Sequence: Synthetic oligonucleotide
aauaugaucugcagccauuaa

SEQ ID NO: 1056 - RNA, 21 nt, Artificial Sequence
  Description of Artificial Sequence: Synthetic oligonucleotide
auaugaucugcagccauuaaa

SEQ ID NO: 1057 - RNA, 21 nt, Artificial Sequence
  Description of Artificial Sequence: Synthetic oligonucleotide
auaugaucugcagccauuaaa

SEQ ID NO: 1058 - RNA, 21 nt, Artificial Sequence
  Description of Artificial Sequence: Synthetic oligonucleotide
uaugaucugcagccauuaaaa

SEQ ID NO: 1059 - RNA, 21 nt, Artificial Sequence
  Description of Artificial Sequence: Synthetic oligonucleotide
uaugaucugcagccauuaaaa

SEQ ID NO: 1060 - RNA, 21 nt, Artificial Sequence
  Description of Artificial Sequence: Synthetic oligonucleotide
augaucugcagccauuaaaaa

SEQ ID NO: 1061 - RNA, 21 nt, Artificial Sequence
  Description of Artificial Sequence: Synthetic oligonucleotide
augaucugcagccauuaaaaa

SEQ ID NO: 1062 - RNA, 21 nt, Artificial Sequence
  Description of Artificial Sequence: Synthetic oligonucleotide
ugaucugcagccauuaaaaag

SEQ ID NO: 1063 - RNA, 21 nt, Artificial Sequence
  Description of Artificial Sequence: Synthetic oligonucleotide
ugaucugcagccauuaaaaag

SEQ ID NO: 1064 - RNA, 21 nt, Artificial Sequence
  Description of Artificial Sequence: Synthetic oligonucleotide
gaucugcagccauuaaaaaga

SEQ ID NO: 1065 - RNA, 21 nt, Artificial Sequence
  Description of Artificial Sequence: Synthetic oligonucleotide
gaucugcagccauuaaaaaga

SEQ ID NO: 1066 - RNA, 21 nt, Artificial Sequence
  Description of Artificial Sequence: Synthetic oligonucleotide
aucugcagccauuaaaaagac

SEQ ID NO: 1067 - RNA, 21 nt, Artificial Sequence
  Description of Artificial Sequence: Synthetic oligonucleotide
aucugcagccauuaaaaagac

SEQ ID NO: 1068 - RNA, 21 nt, Artificial Sequence
  Description of Artificial Sequence: Synthetic oligonucleotide
ucugcagccauuaaaaagaca

SEQ ID NO: 1069 - RNA, 21 nt, Artificial Sequence
  Description of Artificial Sequence: Synthetic oligonucleotide
ucugcagccauuaaaaagaca

SEQ ID NO: 1070 - RNA, 21 nt, Artificial Sequence
  Description of Artificial Sequence: Synthetic oligonucleotide
cugcagccauuaaaaagacac

SEQ ID NO: 1071 - RNA, 21 nt, Artificial Sequence
  Description of Artificial Sequence: Synthetic oligonucleotide
cugcagccauuaaaaagacac

SEQ ID NO: 1072 - RNA, 21 nt, Artificial Sequence
  Description of Artificial Sequence: Synthetic oligonucleotide
ugcagccauuaaaaagacaca

SEQ ID NO: 1073 - RNA, 21 nt, Artificial Sequence
  Description of Artificial Sequence: Synthetic oligonucleotide
ugcagccauuaaaaagacaca

SEQ ID NO: 1074 - RNA, 21 nt, Artificial Sequence
  Description of Artificial Sequence: Synthetic oligonucleotide
gcagccauuaaaaagacacau

SEQ ID NO: 1075 - RNA, 21 nt, Artificial Sequence
  Description of Artificial Sequence: Synthetic oligonucleotide
gcagccauuaaaaagacacau

SEQ ID NO: 1076 - RNA, 21 nt, Artificial Sequence
  Description of Artificial Sequence: Synthetic oligonucleotide
cagccauuaaaaagacacauu

SEQ ID NO: 1077 - RNA, 21 nt, Artificial Sequence
  Description of Artificial Sequence: Synthetic oligonucleotide
cagccauuaaaaagacacauu

SEQ ID NO: 1078 - RNA, 21 nt, Artificial Sequence
  Description of Artificial Sequence: Synthetic oligonucleotide
agccauuaaaaagacacauuc

SEQ ID NO: 1079 - RNA, 21 nt, Artificial Sequence
  Description of Artificial Sequence: Synthetic oligonucleotide
agccauuaaaaagacacauuc

SEQ ID NO: 1080 - RNA, 21 nt, Artificial Sequence
  Description of Artificial Sequence: Synthetic oligonucleotide
gccauuaaaaagacacauucu

SEQ ID NO: 1081 - RNA, 21 nt, Artificial Sequence
  Description of Artificial Sequence: Synthetic oligonucleotide
gccauuaaaaagacacauucu

SEQ ID NO: 1082 - RNA, 21 nt, Artificial Sequence
  Description of Artificial Sequence: Synthetic oligonucleotide
ccauuaaaaagacacauucug

SEQ ID NO: 1083 - RNA, 21 nt, Artificial Sequence
  Description of Artificial Sequence: Synthetic oligonucleotide
ccauuaaaaagacacauucug

SEQ ID NO: 1084 - RNA, 21 nt, Artificial Sequence
  Description of Artificial Sequence: Synthetic oligonucleotide
cauuaaaaagacacauucugu

SEQ ID NO: 1085 - RNA, 21 nt, Artificial Sequence
  Description of Artificial Sequence: Synthetic oligonucleotide
cauuaaaaagacacauucugu

SEQ ID NO: 1086 - RNA, 21 nt, Artificial Sequence
  Description of Artificial Sequence: Synthetic oligonucleotide
auuaaaaagacacauucugua

SEQ ID NO: 1087 - RNA, 21 nt, Artificial Sequence
  Description of Artificial Sequence: Synthetic oligonucleotide
auuaaaaagacacauucugua

SEQ ID NO: 1088 - RNA, 21 nt, Artificial Sequence
  Description of Artificial Sequence: Synthetic oligonucleotide
uuaaaaagacacauucuguaa

SEQ ID NO: 1089 - RNA, 21 nt, Artificial Sequence
  Description of Artificial Sequence: Synthetic oligonucleotide
uuaaaaagacacauucuguaa

SEQ ID NO: 1090 - RNA, 21 nt, Artificial Sequence
  Description of Artificial Sequence: Synthetic oligonucleotide
uaaaaagacacauucuguaaa

SEQ ID NO: 1091 - RNA, 21 nt, Artificial Sequence
  Description of Artificial Sequence: Synthetic oligonucleotide
uaaaaagacacauucuguaaa

SEQ ID NO: 1092 - RNA, 21 nt, Artificial Sequence
  Description of Artificial Sequence: Synthetic oligonucleotide
aaaaagacacauucuguaaaa

SEQ ID NO: 1093 - RNA, 21 nt, Artificial Sequence
  Description of Artificial Sequence: Synthetic oligonucleotide
aaaaagacacauucuguaaaa

SEQ ID NO: 1094 - RNA, 21 nt, Artificial Sequence
  Description of Artificial Sequence: Synthetic oligonucleotide
aaaagacacauucuguaaaaa

SEQ ID NO: 1095 - RNA, 21 nt, Artificial Sequence
  Description of Artificial Sequence: Synthetic oligonucleotide
aaaagacacauucuguaaaaa

SEQ ID NO: 1096 - RNA, 21 nt, Artificial Sequence
  Description of Artificial Sequence: Synthetic oligonucleotide
aaagacacauucuguaaaaaa

SEQ ID NO: 1097 - RNA, 21 nt, Artificial Sequence
  Description of Artificial Sequence: Synthetic oligonucleotide
aaagacacauucuguaaaaaa

SEQ ID NO: 1098 - RNA, 21 nt, Artificial Sequence
  Description of Artificial Sequence: Synthetic oligonucleotide
aagacacauucuguaaaaaaa

SEQ ID NO: 1099 - RNA, 21 nt, Artificial Sequence
  Description of Artificial Sequence: Synthetic oligonucleotide
aagacacauucuguaaaaaaa

SEQ ID NO: 1100 - RNA, 21 nt, Artificial Sequence
  Description of Artificial Sequence: Synthetic oligonucleotide
agacacauucuguaaaaaaaa

SEQ ID NO: 1101 - RNA, 21 nt, Artificial Sequence
  Description of Artificial Sequence: Synthetic oligonucleotide
agacacauucuguaaaaaaaa

SEQ ID NO: 1102 - RNA, 21 nt, Artificial Sequence
  Description of Artificial Sequence: Synthetic oligonucleotide
gacacauucuguaaaaaaaaa

SEQ ID NO: 1103 - RNA, 21 nt, Artificial Sequence
  Description of Artificial Sequence: Synthetic oligonucleotide
gacacauucuguaaaaaaaaa

SEQ ID NO: 1104 - RNA, 21 nt, Artificial Sequence
  Description of Artificial Sequence: Synthetic oligonucleotide
acacauucuguaaaaaaaaaa

SEQ ID NO: 1105 - RNA, 21 nt, Artificial Sequence
  Description of Artificial Sequence: Synthetic oligonucleotide
acacauucuguaaaaaaaaaa

SEQ ID NO: 1106 - RNA, 21 nt, Artificial Sequence
  Description of Artificial Sequence: Synthetic oligonucleotide
cacauucuguaaaaaaaaaaa

SEQ ID NO: 1107 - RNA, 21 nt, Artificial Sequence
  Description of Artificial Sequence: Synthetic oligonucleotide
cacauucuguaaaaaaaaaaa

SEQ ID NO: 1108 - RNA, 21 nt, Artificial Sequence
  Description of Artificial Sequence: Synthetic oligonucleotide
acauucuguaaaaaaaaaaaa

SEQ ID NO: 1109 - RNA, 21 nt, Artificial Sequence
  Description of Artificial Sequence: Synthetic oligonucleotide
acauucuguaaaaaaaaaaaa

SEQ ID NO: 1110 - RNA, 23 nt, Artificial Sequence
  Description of Artificial Sequence: Synthetic oligonucleotide
auggaauacucuugguuacauga

SEQ ID NO: 1111 - RNA, 23 nt, Artificial Sequence
  Description of Artificial Sequence: Synthetic oligonucleotide
auggaauacucuugguuacauga

SEQ ID NO: 1112 - RNA, 23 nt, Artificial Sequence
  Description of Artificial Sequence: Synthetic oligonucleotide
auggaauacucuugguuacauga

SEQ ID NO: 1113 - RNA, 23 nt, Artificial Sequence
  Description of Artificial Sequence: Synthetic oligonucleotide
auggaauacucuugguuacauga

SEQ ID NO: 1114 - RNA, 23 nt, Artificial Sequence
  Description of Artificial Sequence: Synthetic oligonucleotide
auggaauacucuugguuacauga

SEQ ID NO: 1115 - RNA, 23 nt, Artificial Sequence
  Description of Artificial Sequence: Synthetic oligonucleotide
auggaauacucuugguuacauga

SEQ ID NO: 1116 - RNA, 23 nt, Artificial Sequence
  Description of Artificial Sequence: Synthetic oligonucleotide
auggaauacucuugguuacauga

SEQ ID NO: 1117 - RNA, 23 nt, Artificial Sequence
  Description of Artificial Sequence: Synthetic oligonucleotide
auggaauacucuugguuacauga

SEQ ID NO: 1118 - RNA, 23 nt, Artificial Sequence
  Description of Artificial Sequence: Synthetic oligonucleotide
auggaauacucuugguuacauga

SEQ ID NO: 1119 - RNA, 23 nt, Artificial Sequence
  Description of Artificial Sequence: Synthetic oligonucleotide
ucuugguuacaugaaaucccauc

SEQ ID NO: 1120 - RNA, 23 nt, Artificial Sequence
  Description of Artificial Sequence: Synthetic oligonucleotide
ucuugguuacaugaaaucccauc

SEQ ID NO: 1121 - RNA, 23 nt, Artificial Sequence
  Description of Artificial Sequence: Synthetic oligonucleotide
auggaauacucuugguuacauga

SEQ ID NO: 1122 - RNA, 23 nt, Artificial Sequence
  Description of Artificial Sequence: Synthetic oligonucleotide
ucuugguuacaugaaaucccauc

SEQ ID NO: 1123 - DNA, 23 bp, Artificial Sequence
  Description of Artificial Sequence: Synthetic oligonucleotide
  Description of Combined DNA/RNA Molecule: Synthetic oligonucleotide
auggaauacucuuggutacatga

SEQ ID NO: 1124 - RNA, 23 nt, Artificial Sequence
  Description of Artificial Sequence: Synthetic oligonucleotide
auggaauacucuugguuacauga

SEQ ID NO: 1125 - DNA, 23 bp, Artificial Sequence
  Description of Artificial Sequence: Synthetic oligonucleotide
  Description of Combined DNA/RNA Molecule: Synthetic oligonucleotide
auggaatacucuugguuacauga

SEQ ID NO: 1126 - RNA, 23 nt, Artificial Sequence
  Description of Artificial Sequence: Synthetic oligonucleotide
auggaauacucuugguuacauga

SEQ ID NO: 1127 - RNA, 23 nt, Artificial Sequence
  Description of Artificial Sequence: Synthetic oligonucleotide
ucuugguuacaugaaaucccauc

SEQ ID NO: 1128 - RNA, 23 nt, Artificial Sequence
  Description of Artificial Sequence: Synthetic oligonucleotide
auggaauacucuugguuacauga

SEQ ID NO: 1129 - RNA, 23 nt, Artificial Sequence
  Description of Artificial Sequence: Synthetic oligonucleotide
auggaauacucuugguuacauga

SEQ ID NO: 1130 - RNA, 23 nt, Artificial Sequence
  Description of Artificial Sequence: Synthetic oligonucleotide
auggaauacucuugguuacauga

SEQ ID NO: 1131 - RNA, 23 nt, Artificial Sequence
  Description of Artificial Sequence: Synthetic oligonucleotide
auggaauacucuugguuacauga

SEQ ID NO: 1132 - DNA, 23 bp, Artificial Sequence
  Description of Artificial Sequence: Synthetic oligonucleotide
  Description of Combined DNA/RNA Molecule: Synthetic oligonucleotide
uctuggtuacaugaaaucccatc

SEQ ID NO: 1133 - RNA, 23 nt, Artificial Sequence
  Description of Artificial Sequence: Synthetic oligonucleotide
auggaauacucuugguuacauga

SEQ ID NO: 1134 - RNA, 23 nt, Artificial Sequence
  Description of Artificial Sequence: Synthetic oligonucleotide
ucuugguuacaugaaaucccauc

SEQ ID NO: 1135 - RNA, 23 nt, Artificial Sequence
  Description of Artificial Sequence: Synthetic oligonucleotide
ucuugguuacaugaaaucccauc

SEQ ID NO: 1136 - RNA, 23 nt, Artificial Sequence
  Description of Artificial Sequence: Synthetic oligonucleotide
ucuugguuacaugaaaucccauc

SEQ ID NO: 1137 - RNA, 23 nt, Artificial Sequence
  Description of Artificial Sequence: Synthetic oligonucleotide
ucuugguuacaugaaaucccauc

SEQ ID NO: 1138 - DNA, 23 bp, Artificial Sequence
  Description of Artificial Sequence: Synthetic oligonucleotide
  Description of Combined DNA/RNA Molecule: Synthetic oligonucleotide
atggaatactcuugguuacauga

SEQ ID NO: 1139 - DNA, 23 bp, Artificial Sequence
  Description of Artificial Sequence: Synthetic oligonucleotide
  Description of Combined DNA/RNA Molecule: Synthetic oligonucleotide
auggaatacucutggutacatga

SEQ ID NO: 1140 - RNA, 23 nt, Artificial Sequence
  Description of Artificial Sequence: Synthetic oligonucleotide
ucuugguuacaugaaaucccauc

SEQ ID NO: 1141 - RNA, 23 nt, Artificial Sequence
  Description of Artificial Sequence: Synthetic oligonucleotide
auggaauacucuugguuacauga

SEQ ID NO: 1142 - RNA, 23 nt, Artificial Sequence
  Description of Artificial Sequence: Synthetic oligonucleotide
auggaauacucuugguuacauga

SEQ ID NO: 1143 - RNA, 23 nt, Artificial Sequence
  Description of Artificial Sequence: Synthetic oligonucleotide
ucuugguuacaugaaaucccauc

SEQ ID NO: 1144 - RNA, 23 nt, Artificial Sequence
  Description of Artificial Sequence: Synthetic oligonucleotide
auggaauacucuugguuacauga

SEQ ID NO: 1145 - RNA, 23 nt, Artificial Sequence
  Description of Artificial Sequence: Synthetic oligonucleotide
ucuugguuacaugaaaucccauc

SEQ ID NO: 1146 - RNA, 23 nt, Artificial Sequence
  Description of Artificial Sequence: Synthetic oligonucleotide
ucuugguuacaugaaaucccauc

SEQ ID NO: 1147 - RNA, 23 nt, Artificial Sequence
  Description of Artificial Sequence: Synthetic oligonucleotide
ucuugguuacaugaaaucccauc

SEQ ID NO: 1148 - RNA, 23 nt, Artificial Sequence
  Description of Artificial Sequence: Synthetic oligonucleotide
ucuugguuacaugaaaucccauc

SEQ ID NO: 1149 - RNA, 23 nt, Artificial Sequence
  Description of Artificial Sequence: Synthetic oligonucleotide
auggaauacucuugguuacauga

SEQ ID NO: 1150 - RNA, 23 nt, Artificial Sequence
  Description of Artificial Sequence: Synthetic oligonucleotide
auggaauacucuugguuacauga

SEQ ID NO: 1151 - RNA, 23 nt, Artificial Sequence
  Description of Artificial Sequence: Synthetic oligonucleotide
auggaauacucuugguuacauga

SEQ ID NO: 1152 - RNA, 23 nt, Artificial Sequence
  Description of Artificial Sequence: Synthetic oligonucleotide
ucuugguuacaugaaaucccauc

SEQ ID NO: 1153 - RNA, 23 nt, Artificial Sequence
  Description of Artificial Sequence: Synthetic oligonucleotide
auggaauacucuugguuacauga

SEQ ID NO: 1154 - RNA, 23 nt, Artificial Sequence
  Description of Artificial Sequence: Synthetic oligonucleotide
auggaauacucuugguuacauga

SEQ ID NO: 1155 - RNA, 23 nt, Artificial Sequence
  Description of Artificial Sequence: Synthetic oligonucleotide
auggaauacucuugguuacauga

SEQ ID NO: 1156 - RNA, 23 nt, Artificial Sequence
  Description of Artificial Sequence: Synthetic oligonucleotide
auggaauacucuugguuacauga

SEQ ID NO: 1157 - RNA, 23 nt, Artificial Sequence
  Description of Artificial Sequence: Synthetic oligonucleotide
ucuugguuacaugaaaucccauc

SEQ ID NO: 1158 - RNA, 23 nt, Artificial Sequence
  Description of Artificial Sequence: Synthetic oligonucleotide
auggaauacucuugguuacauga

SEQ ID NO: 1159 - RNA, 23 nt, Artificial Sequence
  Description of Artificial Sequence: Synthetic oligonucleotide
auggaauacucuugguuacauga

SEQ ID NO: 1160 - RNA, 23 nt, Artificial Sequence
  Description of Artificial Sequence: Synthetic oligonucleotide
ucuugguuacaugaaaucccauc

SEQ ID NO: 1161 - DNA, 23 bp, Artificial Sequence
  Description of Artificial Sequence: Synthetic oligonucleotide
  Description of Combined DNA/RNA Molecule: Synthetic oligonucleotide
auggaauactctuggtuacauga

SEQ ID NO: 1162 - RNA, 23 nt, Artificial Sequence
  Description of Artificial Sequence: Synthetic oligonucleotide
auggaauacucuugguuacauga

SEQ ID NO: 1163 - DNA, 23 bp, Artificial Sequence
  Description of Artificial Sequence: Synthetic oligonucleotide
  Description of Combined DNA/RNA Molecule: Synthetic oligonucleotide
auggaauacucuugguuacauga

SEQ ID NO: 1164 - DNA, 23 bp, Artificial Sequence
  Description of Artificial Sequence: Synthetic oligonucleotide
  Description of Combined DNA/RNA Molecule: Synthetic oligonucleotide
atggaauacucuugguuacauga

SEQ ID NO: 1165 - DNA, 23 bp, Artificial Sequence
  Description of Artificial Sequence: Synthetic oligonucleotide
  Description of Combined DNA/RNA Molecule: Synthetic oligonucleotide
auggaatacucuugguuacauga

SEQ ID NO: 1166 - RNA, 23 nt, Artificial Sequence
  Description of Artificial Sequence: Synthetic oligonucleotide
auggaauacucuugguuacauga

SEQ ID NO: 1167 - RNA, 23 nt, Artificial Sequence
  Description of Artificial Sequence: Synthetic oligonucleotide
auggaauacucuugguuacauga

SEQ ID NO: 1168 - DNA, 23 bp, Artificial Sequence
  Description of Artificial Sequence: Synthetic oligonucleotide
  Description of Combined DNA/RNA Molecule: Synthetic oligonucleotide
auggaauactctuggtuacauga

SEQ ID NO: 1169 - DNA, 23 bp, Artificial Sequence
  Description of Artificial Sequence: Synthetic oligonucleotide
  Description of Combined DNA/RNA Molecule: Synthetic oligonucleotide
auggaatacucuugguuacauga

SEQ ID NO: 1170 - DNA, 23 bp, Artificial Sequence
  Description of Artificial Sequence: Synthetic oligonucleotide
  Description of Combined DNA/RNA Molecule: Synthetic oligonucleotide
atggaatactcuugguuacatga

SEQ ID NO: 1171 - DNA, 23 bp, Artificial Sequence
  Description of Artificial Sequence: Synthetic oligonucleotide
  Description of Combined DNA/RNA Molecule: Synthetic oligonucleotide
atggaauactcuugguuacauga

SEQ ID NO: 1172 - RNA, 23 nt, Artificial Sequence
  Description of Artificial Sequence: Synthetic oligonucleotide
auggaauacucuugguuacauga

SEQ ID NO: 1173 - DNA, 23 bp, Artificial Sequence
  Description of Artificial Sequence: Synthetic oligonucleotide
  Description of Combined DNA/RNA Molecule: Synthetic oligonucleotide
atggaauactcutggutacatga

SEQ ID NO: 1174 - DNA, 23 bp, Artificial Sequence
  Description of Artificial Sequence: Synthetic oligonucleotide
  Description of Combined DNA/RNA Molecule: Synthetic oligonucleotide
atggaatacucuugguuacauga

SEQ ID NO: 1175 - DNA, 23 bp, Artificial Sequence
  Description of Artificial Sequence: Synthetic oligonucleotide
  Description of Combined DNA/RNA Molecule: Synthetic oligonucleotide
auggaatacucuugguuacauga

SEQ ID NO: 1176 - DNA, 23 bp, Artificial Sequence
  Description of Artificial Sequence: Synthetic oligonucleotide
  Description of Combined DNA/RNA Molecule: Synthetic oligonucleotide
atggaatacucuugguuacauga

SEQ ID NO: 1177 - RNA, 23 nt, Artificial Sequence
  Description of Artificial Sequence: Synthetic oligonucleotide
auggaauacucuugguuacauga

SEQ ID NO: 1178 - DNA, 23 bp, Artificial Sequence
  Description of Artificial Sequence: Synthetic oligonucleotide
  Description of Combined DNA/RNA Molecule: Synthetic oligonucleotide
auggaauacucuugguuacauga

SEQ ID NO: 1179 - RNA, 23 nt, Artificial Sequence
  Description of Artificial Sequence: Synthetic oligonucleotide
auggaauacucuugguuacauga

SEQ ID NO: 1180 - RNA, 23 nt, Artificial Sequence
  Description of Artificial Sequence: Synthetic oligonucleotide
auggaauacucuugguuacauga

SEQ ID NO: 1181 - RNA, 23 nt, Artificial Sequence
  Description of Artificial Sequence: Synthetic oligonucleotide
ucuugguuacaugaaaucccauc

SEQ ID NO: 1182 - RNA, 23 nt, Artificial Sequence
  Description of Artificial Sequence: Synthetic oligonucleotide
auggaauacucuugguuacauga

SEQ ID NO: 1183 - DNA, 23 bp, Artificial Sequence
  Description of Artificial Sequence: Synthetic oligonucleotide
  Description of Combined DNA/RNA Molecule: Synthetic oligonucleotide
auggaatacucuugguuacauga

SEQ ID NO: 1184 - RNA, 23 nt, Artificial Sequence
  Description of Artificial Sequence: Synthetic oligonucleotide
auggaauacucuugguuacauga

SEQ ID NO: 1185 - DNA, 23 bp, Artificial Sequence
  Description of Artificial Sequence: Synthetic oligonucleotide
  Description of Combined DNA/RNA Molecule: Synthetic oligonucleotide
auggaatacucuugguuacauga

SEQ ID NO: 1186 - DNA, 23 bp, Artificial Sequence
  Description of Artificial Sequence: Synthetic oligonucleotide
  Description of Combined DNA/RNA Molecule: Synthetic oligonucleotide
auggaatacucuugguuacauga

SEQ ID NO: 1187 - RNA, 23 nt, Artificial Sequence
  Description of Artificial Sequence: Synthetic oligonucleotide
auggaauacucuugguuacauga

SEQ ID NO: 1188 - DNA, 23 bp, Artificial Sequence
  Description of Artificial Sequence: Synthetic oligonucleotide
  Description of Combined DNA/RNA Molecule: Synthetic oligonucleotide
auggaatacucuugguuacauga

SEQ ID NO: 1189 - DNA, 23 bp, Artificial Sequence
  Description of Artificial Sequence: Synthetic oligonucleotide
  Description of Combined DNA/RNA Molecule: Synthetic oligonucleotide
auggaatacucuugguuacauga

SEQ ID NO: 1190 - RNA, 23 nt, Artificial Sequence
  Description of Artificial Sequence: Synthetic oligonucleotide
auggaauacucuugguuacauga

SEQ ID NO: 1191 - DNA, 23 bp, Artificial Sequence
  Description of Artificial Sequence: Synthetic oligonucleotide
  Description of Combined DNA/RNA Molecule: Synthetic oligonucleotide
atggaauacucuugguuacauga

SEQ ID NO: 1192 - DNA, 23 bp, Artificial Sequence
  Description of Artificial Sequence: Synthetic oligonucleotide
  Description of Combined DNA/RNA Molecule: Synthetic oligonucleotide
auggaauacucuuggutacauga

SEQ ID NO: 1193 - DNA, 23 bp, Artificial Sequence
  Description of Artificial Sequence: Synthetic oligonucleotide
  Description of Combined DNA/RNA Molecule: Synthetic oligonucleotide
atggaatacucuugguuacauga

SEQ ID NO: 1194 - RNA, 23 nt, Artificial Sequence
  Description of Artificial Sequence: Synthetic oligonucleotide
auggaauacucuugguuacauga

SEQ ID NO: 1195 - RNA, 23 nt, Artificial Sequence
  Description of Artificial Sequence: Synthetic oligonucleotide
auggaauacucuugguuacauga

SEQ ID NO: 1196 - RNA, 23 nt, Artificial Sequence
  Description of Artificial Sequence: Synthetic oligonucleotide
auggaauacucuugguuacauga

SEQ ID NO: 1197 - RNA, 23 nt, Artificial Sequence
  Description of Artificial Sequence: Synthetic oligonucleotide
auggaauacucuugguuacauga

SEQ ID NO: 1198 - RNA, 23 nt, Artificial Sequence
  Description of Artificial Sequence: Synthetic oligonucleotide
auggaauacucuugguuacauga

SEQ ID NO: 1199 - RNA, 23 nt, Artificial Sequence
  Description of Artificial Sequence: Synthetic oligonucleotide
auggaauacucuugguuacauga

SEQ ID NO: 1200 - RNA, 23 nt, Artificial Sequence
  Description of Artificial Sequence: Synthetic oligonucleotide
auggaauacucuugguuacauga

SEQ ID NO: 1201 - RNA, 23 nt, Artificial Sequence
  Description of Artificial Sequence: Synthetic oligonucleotide
auggaauacucuugguuacauga

SEQ ID NO: 1202 - RNA, 23 nt, Artificial Sequence
  Description of Artificial Sequence: Synthetic oligonucleotide
auggaauacucuugguuacauga

SEQ ID NO: 1203 - RNA, 23 nt, Artificial Sequence
  Description of Artificial Sequence: Synthetic oligonucleotide
auggaauacucuugguuacauga

SEQ ID NO: 1204 - RNA, 23 nt, Artificial Sequence
  Description of Artificial Sequence: Synthetic oligonucleotide
auggaauacucuugguuacauga

SEQ ID NO: 1205 - RNA, 23 nt, Artificial Sequence
  Description of Artificial Sequence: Synthetic oligonucleotide
auggaauacucuugguuacauga

SEQ ID NO: 1206 - RNA, 23 nt, Artificial Sequence
  Description of Artificial Sequence: Synthetic oligonucleotide
auggaauacucuugguuacauga

SEQ ID NO: 1207 - RNA, 23 nt, Artificial Sequence
  Description of Artificial Sequence: Synthetic oligonucleotide
auggaauacucuugguuacauga

SEQ ID NO: 1208 - RNA, 23 nt, Artificial Sequence
  Description of Artificial Sequence: Synthetic oligonucleotide
auggaauacucuugguuacauga

SEQ ID NO: 1209 - DNA, 23 bp, Artificial Sequence
  Description of Artificial Sequence: Synthetic oligonucleotide
  Description of Combined DNA/RNA Molecule: Synthetic oligonucleotide
auggaatacucuugguuacauga

SEQ ID NO: 1210 - RNA, 23 nt, Artificial Sequence
  Description of Artificial Sequence: Synthetic oligonucleotide
auggaauacucuugguuacauga

SEQ ID NO: 1211 - RNA, 23 nt, Artificial Sequence
  Description of Artificial Sequence: Synthetic oligonucleotide
auggaauacucuugguuacauga

SEQ ID NO: 1212 - DNA, 23 bp, Artificial Sequence
  Description of Artificial Sequence: Synthetic oligonucleotide
  Description of Combined DNA/RNA Molecule: Synthetic oligonucleotide
auggaauacuctugguuacauga

SEQ ID NO: 1213 - RNA, 23 nt, Artificial Sequence
  Description of Artificial Sequence: Synthetic oligonucleotide
auggaauacucuugguuacauga

SEQ ID NO: 1214 - RNA, 23 nt, Artificial Sequence
  Description of Artificial Sequence: Synthetic oligonucleotide
auggaauacucuugguuacauga

SEQ ID NO: 1215 - RNA, 23 nt, Artificial Sequence
  Description of Artificial Sequence: Synthetic oligonucleotide
auggaauacucuugguuacauga

SEQ ID NO: 1216 - RNA, 23 nt, Artificial Sequence
  Description of Artificial Sequence: Synthetic oligonucleotide
auggaauacucuugguuacauga

SEQ ID NO: 1217 - RNA, 23 nt, Artificial Sequence
  Description of Artificial Sequence: Synthetic oligonucleotide
auggaauacucuugguuacauga

SEQ ID NO: 1218 - RNA, 23 nt, Artificial Sequence
  Description of Artificial Sequence: Synthetic oligonucleotide
auggaauacucuugguuacauga

SEQ ID NO: 1219 - RNA, 23 nt, Artificial Sequence
  Description of Artificial Sequence: Synthetic oligonucleotide
auggaauacucuugguuacauga

SEQ ID NO: 1220 - RNA, 23 nt, Artificial Sequence
  Description of Artificial Sequence: Synthetic oligonucleotide
auggaauacucuugguuacauga

SEQ ID NO: 1221 - DNA, 23 bp, Artificial Sequence
  Description of Artificial Sequence: Synthetic oligonucleotide
  Description of Combined DNA/RNA Molecule: Synthetic oligonucleotide
auggaauacucuugguuacauga

SEQ ID NO: 1222 - RNA, 23 nt, Artificial Sequence
  Description of Artificial Sequence: Synthetic oligonucleotide
auggaauacucuugguuacauga

SEQ ID NO: 1223 - RNA, 23 nt, Artificial Sequence
  Description of Artificial Sequence: Synthetic oligonucleotide
auggaauacucuugguuacauga

SEQ ID NO: 1224 - RNA, 23 nt, Artificial Sequence
  Description of Artificial Sequence: Synthetic oligonucleotide
auggaauacucuugguuacauga

SEQ ID NO: 1225 - RNA, 23 nt, Artificial Sequence
  Description of Artificial Sequence: Synthetic oligonucleotide
auggaauacucuugguuacauga

SEQ ID NO: 1226 - DNA, 23 bp, Artificial Sequence
  Description of Artificial Sequence: Synthetic oligonucleotide
  Description of Combined DNA/RNA Molecule: Synthetic oligonucleotide
atggaatacucuugguuacauga

SEQ ID NO: 1227 - RNA, 23 nt, Artificial Sequence
  Description of Artificial Sequence: Synthetic oligonucleotide
auggaauacucuugguuacauga

SEQ ID NO: 1228 - RNA, 23 nt, Artificial Sequence
  Description of Artificial Sequence: Synthetic oligonucleotide
auggaauacucuugguuacauga

SEQ ID NO: 1229 - RNA, 23 nt, Artificial Sequence
  Description of Artificial Sequence: Synthetic oligonucleotide
auggaauacucuugguuacauga

SEQ ID NO: 1230 - RNA, 23 nt, Artificial Sequence
  Description of Artificial Sequence: Synthetic oligonucleotide
auggaauacucuugguuacauga

SEQ ID NO: 1231 - RNA, 23 nt, Artificial Sequence
  Description of Artificial Sequence: Synthetic oligonucleotide
auggaauacucuugguuacauga

SEQ ID NO: 1232 - RNA, 23 nt, Artificial Sequence
  Description of Artificial Sequence: Synthetic oligonucleotide
auggaauacucuugguuacauga

SEQ ID NO: 1233 - RNA, 23 nt, Artificial Sequence
  Description of Artificial Sequence: Synthetic oligonucleotide
auggaauacucuugguuacauga

SEQ ID NO: 1234 - RNA, 23 nt, Artificial Sequence
  Description of Artificial Sequence: Synthetic oligonucleotide
auggaauacucuugguuacauga

SEQ ID NO: 1235 - RNA, 23 nt, Artificial Sequence
  Description of Artificial Sequence: Synthetic oligonucleotide
auggaauacucuugguuacauga

SEQ ID NO: 1236 - RNA, 23 nt, Artificial Sequence
  Description of Artificial Sequence: Synthetic oligonucleotide
auggaauacucuugguuacauga

SEQ ID NO: 1237 - RNA, 23 nt, Artificial Sequence
  Description of Artificial Sequence: Synthetic oligonucleotide
auggaauacucuugguuacauga

SEQ ID NO: 1238 - RNA, 23 nt, Artificial Sequence
  Description of Artificial Sequence: Synthetic oligonucleotide
auggaauacucuugguuacauga

SEQ ID NO: 1239 - RNA, 23 nt, Artificial Sequence
  Description of Artificial Sequence: Synthetic oligonucleotide
auggaauacucuugguuacauga

SEQ ID NO: 1240 - RNA, 23 nt, Artificial Sequence
  Description of Artificial Sequence: Synthetic oligonucleotide
auggaauacucuugguuacauga

SEQ ID NO: 1241 - RNA, 23 nt, Artificial Sequence
  Description of Artificial Sequence: Synthetic oligonucleotide
auggaauacucuugguuacauga

SEQ ID NO: 1242 - RNA, 23 nt, Artificial Sequence
  Description of Artificial Sequence: Synthetic oligonucleotide
auggaauacucuugguuacauga

SEQ ID NO: 1243 - RNA, 23 nt, Artificial Sequence
  Description of Artificial Sequence: Synthetic oligonucleotide
auggaauacucuugguuacauga

SEQ ID NO: 1244 - RNA, 23 nt, Artificial Sequence
  Description of Artificial Sequence: Synthetic oligonucleotide
auggaauacucuugguuacauga

SEQ ID NO: 1245 - RNA, 23 nt, Artificial Sequence
  Description of Artificial Sequence: Synthetic oligonucleotide
auggaauacucuugguuacauga

SEQ ID NO: 1246 - RNA, 23 nt, Artificial Sequence
  Description of Artificial Sequence: Synthetic oligonucleotide
auggaauacucuugguuacauga

SEQ ID NO: 1247 - RNA, 23 nt, Artificial Sequence
  Description of Artificial Sequence: Synthetic oligonucleotide
auggaauacucuugguuacauga

SEQ ID NO: 1248 - RNA, 23 nt, Artificial Sequence
  Description of Artificial Sequence: Synthetic oligonucleotide
auggaauacucuugguuacauga

SEQ ID NO: 1249 - RNA, 23 nt, Artificial Sequence
  Description of Artificial Sequence: Synthetic oligonucleotide
auggaauacucuugguuacauga

SEQ ID NO: 1250 - RNA, 23 nt, Artificial Sequence
  Description of Artificial Sequence: Synthetic oligonucleotide
auggaauacucuugguuacauga

SEQ ID NO: 1251 - RNA, 23 nt, Artificial Sequence
  Description of Artificial Sequence: Synthetic oligonucleotide
auggaauacucuugguuacauga

SEQ ID NO: 1252 - RNA, 23 nt, Artificial Sequence
  Description of Artificial Sequence: Synthetic oligonucleotide
auggaauacucuugguuacauga

SEQ ID NO: 1253 - RNA, 23 nt, Artificial Sequence
  Description of Artificial Sequence: Synthetic oligonucleotide
auggaauacucuugguuacauga

SEQ ID NO: 1254 - RNA, 23 nt, Artificial Sequence
  Description of Artificial Sequence: Synthetic oligonucleotide
auggaauacucuugguuacauga

SEQ ID NO: 1255 - RNA, 23 nt, Artificial Sequence
  Description of Artificial Sequence: Synthetic oligonucleotide
auggaauacucuugguuacauga

SEQ ID NO: 1256 - RNA, 23 nt, Artificial Sequence
  Description of Artificial Sequence: Synthetic oligonucleotide
auggaauacucuugguuacauga

SEQ ID NO: 1257 - RNA, 23 nt, Artificial Sequence
  Description of Artificial Sequence: Synthetic oligonucleotide
auggaauacucuugguuacauga

SEQ ID NO: 1258 - RNA, 23 nt, Artificial Sequence
  Description of Artificial Sequence: Synthetic oligonucleotide
auggaauacucuugguuacauga

SEQ ID NO: 1259 - RNA, 23 nt, Artificial Sequence
  Description of Artificial Sequence: Synthetic oligonucleotide
auggaauacucuugguuacauga

SEQ ID NO: 1260 - RNA, 23 nt, Artificial Sequence
  Description of Artificial Sequence: Synthetic oligonucleotide
auggaauacucuugguuacauga

SEQ ID NO: 1261 - RNA, 23 nt, Artificial Sequence
  Description of Artificial Sequence: Synthetic oligonucleotide
auggaauacucuugguuacauga

SEQ ID NO: 1262 - RNA, 23 nt, Artificial Sequence
  Description of Artificial Sequence: Synthetic oligonucleotide
auggaauacucuugguuacauga

SEQ ID NO: 1263 - RNA, 23 nt, Artificial Sequence
  Description of Artificial Sequence: Synthetic oligonucleotide
auggaauacucuugguuacauga

SEQ ID NO: 1264 - RNA, 23 nt, Artificial Sequence
  Description of Artificial Sequence: Synthetic oligonucleotide
ucuugguuacaugaaaucccauc

SEQ ID NO: 1265 - RNA, 23 nt, Artificial Sequence
  Description of Artificial Sequence: Synthetic oligonucleotide
ucuugguuacaugaaaucccauc

SEQ ID NO: 1266 - RNA, 23 nt, Artificial Sequence
  Description of Artificial Sequence: Synthetic oligonucleotide
ucuugguuacaugaaaucccauc

SEQ ID NO: 1267 - RNA, 23 nt, Artificial Sequence
  Description of Artificial Sequence: Synthetic oligonucleotide
ucuugguuacaugaaaucccauc

SEQ ID NO: 1268 - RNA, 23 nt, Artificial Sequence
  Description of Artificial Sequence: Synthetic oligonucleotide
ucuugguuacaugaaaucccauc

SEQ ID NO: 1269 - RNA, 23 nt, Artificial Sequence
  Description of Artificial Sequence: Synthetic oligonucleotide
ucuugguuacaugaaaucccauc

SEQ ID NO: 1270 - RNA, 23 nt, Artificial Sequence
  Description of Artificial Sequence: Synthetic oligonucleotide
ucuugguuacaugaaaucccauc

SEQ ID NO: 1271 - RNA, 23 nt, Artificial Sequence
  Description of Artificial Sequence: Synthetic oligonucleotide
ucuugguuacaugaaaucccauc

SEQ ID NO: 1272 - RNA, 23 nt, Artificial Sequence
  Description of Artificial Sequence: Synthetic oligonucleotide
auggaauacucuugguuacauga

SEQ ID NO: 1273 - RNA, 23 nt, Artificial Sequence
  Description of Artificial Sequence: Synthetic oligonucleotide
auggaauacucuugguuacauga

SEQ ID NO: 1274 - RNA, 23 nt, Artificial Sequence
  Description of Artificial Sequence: Synthetic oligonucleotide
auggaauacucuugguuacauga

SEQ ID NO: 1275 - RNA, 23 nt, Artificial Sequence
  Description of Artificial Sequence: Synthetic oligonucleotide
auggaauacucuugguuacauga

SEQ ID NO: 1276 - RNA, 23 nt, Artificial Sequence
  Description of Artificial Sequence: Synthetic oligonucleotide
auggaauacucuugguuacauga

SEQ ID NO: 1277 - RNA, 23 nt, Artificial Sequence
  Description of Artificial Sequence: Synthetic oligonucleotide
auggaauacucuugguuacauga

SEQ ID NO: 1278 - RNA, 23 nt, Artificial Sequence
  Description of Artificial Sequence: Synthetic oligonucleotide
auggaauacucuugguuacauga

SEQ ID NO: 1279 - RNA, 23 nt, Artificial Sequence
  Description of Artificial Sequence: Synthetic oligonucleotide
auggaauacucuugguuacauga

SEQ ID NO: 1280 - RNA, 23 nt, Artificial Sequence
  Description of Artificial Sequence: Synthetic oligonucleotide
auggaauacucuugguuacauga

SEQ ID NO: 1281 - RNA, 23 nt, Artificial Sequence
  Description of Artificial Sequence: Synthetic oligonucleotide
auggaauacucuugguuacauga

SEQ ID NO: 1282 - RNA, 23 nt, Artificial Sequence
  Description of Artificial Sequence: Synthetic oligonucleotide
auggaauacucuugguuacauga

SEQ ID NO: 1283 - RNA, 23 nt, Artificial Sequence
  Description of Artificial Sequence: Synthetic oligonucleotide
auggaauacucuugguuacauga

SEQ ID NO: 1284 - RNA, 23 nt, Artificial Sequence
  Description of Artificial Sequence: Synthetic oligonucleotide
auggaauacucuugguuacauga

SEQ ID NO: 1285 - RNA, 23 nt, Artificial Sequence
  Description of Artificial Sequence: Synthetic oligonucleotide
auggaauacucuugguuacauga

SEQ ID NO: 1286 - RNA, 23 nt, Artificial Sequence
  Description of Artificial Sequence: Synthetic oligonucleotide
auggaauacucuugguuacauga

SEQ ID NO: 1287 - RNA, 23 nt, Artificial Sequence
  Description of Artificial Sequence: Synthetic oligonucleotide
auggaauacucuugguuacauga

SEQ ID NO: 1288 - RNA, 23 nt, Artificial Sequence
  Description of Artificial Sequence: Synthetic oligonucleotide
auggaauacucuugguuacauga

SEQ ID NO: 1289 - RNA, 23 nt, Artificial Sequence
  Description of Artificial Sequence: Synthetic oligonucleotide
auggaauacucuugguuacauga

SEQ ID NO: 1290 - RNA, 23 nt, Artificial Sequence
  Description of Artificial Sequence: Synthetic oligonucleotide
auggaauacucuugguuacauga

SEQ ID NO: 1291 - RNA, 23 nt, Artificial Sequence
  Description of Artificial Sequence: Synthetic oligonucleotide
auggaauacucuugguuacauga

SEQ ID NO: 1292 - RNA, 23 nt, Artificial Sequence
  Description of Artificial Sequence: Synthetic oligonucleotide
auggaauacucuugguuacauga

SEQ ID NO: 1293 - RNA, 23 nt, Artificial Sequence
  Description of Artificial Sequence: Synthetic oligonucleotide
auggaauacucuugguuacauga

SEQ ID NO: 1294 - RNA, 23 nt, Artificial Sequence
  Description of Artificial Sequence: Synthetic oligonucleotide
auggaauacucuugguuacauga

SEQ ID NO: 1295 - RNA, 23 nt, Artificial Sequence
  Description of Artificial Sequence: Synthetic oligonucleotide
auggaauacucuugguuacauga

SEQ ID NO: 1296 - RNA, 23 nt, Artificial Sequence
  Description of Artificial Sequence: Synthetic oligonucleotide
auggaauacucuugguuacauga

SEQ ID NO: 1297 - RNA, 23 nt, Artificial Sequence
  Description of Artificial Sequence: Synthetic oligonucleotide
auggaauacucuugguuacauga

SEQ ID NO: 1298 - RNA, 23 nt, Artificial Sequence
  Description of Artificial Sequence: Synthetic oligonucleotide
auggaauacucuugguuacauga

SEQ ID NO: 1299 - RNA, 23 nt, Artificial Sequence
  Description of Artificial Sequence: Synthetic oligonucleotide
auggaauacucuugguuacauga

SEQ ID NO: 1300 - RNA, 23 nt, Artificial Sequence
  Description of Artificial Sequence: Synthetic oligonucleotide
auggaauacucuugguuacauga

SEQ ID NO: 1301 - DNA, 23 bp, Artificial Sequence
  Description of Artificial Sequence: Synthetic oligonucleotide
  Description of Combined DNA/RNA Molecule: Synthetic oligonucleotide
auggaauacucuuggutacatga

SEQ ID NO: 1302 - RNA, 23 nt, Artificial Sequence
  Description of Artificial Sequence: Synthetic oligonucleotide
auggaauacucuugguuacauga

SEQ ID NO: 1303 - RNA, 23 nt, Artificial Sequence
  Description of Artificial Sequence: Synthetic oligonucleotide
auggaauacucuugguuacauga

SEQ ID NO: 1304 - RNA, 23 nt, Artificial Sequence
  Description of Artificial Sequence: Synthetic oligonucleotide
auggaauacucuugguuacauga

SEQ ID NO: 1305 - RNA, 23 nt, Artificial Sequence
  Description of Artificial Sequence: Synthetic oligonucleotide
auggaauacucuugguuacauga

SEQ ID NO: 1306 - RNA, 23 nt, Artificial Sequence
  Description of Artificial Sequence: Synthetic oligonucleotide
auggaauacucuugguuacauga

SEQ ID NO: 1307 - RNA, 23 nt, Artificial Sequence
  Description of Artificial Sequence: Synthetic oligonucleotide
auggaauacucuugguuacauga

SEQ ID NO: 1308 - RNA, 23 nt, Artificial Sequence
  Description of Artificial Sequence: Synthetic oligonucleotide
auggaauacucuugguuacauga

SEQ ID NO: 1309 - RNA, 23 nt, Artificial Sequence
  Description of Artificial Sequence: Synthetic oligonucleotide
auggaauacucuugguuacauga

SEQ ID NO: 1310 - RNA, 23 nt, Artificial Sequence
  Description of Artificial Sequence: Synthetic oligonucleotide
auggaauacucuugguuacauga

SEQ ID NO: 1311 - RNA, 23 nt, Artificial Sequence
  Description of Artificial Sequence: Synthetic oligonucleotide
auggaauacucuugguuacauga

SEQ ID NO: 1312 - RNA, 23 nt, Artificial Sequence
  Description of Artificial Sequence: Synthetic oligonucleotide
auggaauacucuugguuacauga

SEQ ID NO: 1313 - RNA, 23 nt, Artificial Sequence
  Description of Artificial Sequence: Synthetic oligonucleotide
auggaauacucuugguuacauga

SEQ ID NO: 1314 - DNA, 23 bp, Artificial Sequence
  Description of Artificial Sequence: Synthetic oligonucleotide
  Description of Combined DNA/RNA Molecule: Synthetic oligonucleotide
atggaauacucuugguuacauga

SEQ ID NO: 1315 - DNA, 23 bp, Artificial Sequence
  Description of Artificial Sequence: Synthetic oligonucleotide
  Description of Combined DNA/RNA Molecule: Synthetic oligonucleotide
auggaatacucuugguuacauga

SEQ ID NO: 1316 - DNA, 23 bp, Artificial Sequence
  Description of Artificial Sequence: Synthetic oligonucleotide
  Description of Combined DNA/RNA Molecule: Synthetic oligonucleotide
atggaauacucuugguuacauga

SEQ ID NO: 1317 - DNA, 23 bp, Artificial Sequence
  Description of Artificial Sequence: Synthetic oligonucleotide
  Description of Combined DNA/RNA Molecule: Synthetic oligonucleotide
atggaauactcuugguuacauga

SEQ ID NO: 1318 - DNA, 23 bp, Artificial Sequence
  Description of Artificial Sequence: Synthetic oligonucleotide
  Description of Combined DNA/RNA Molecule: Synthetic oligonucleotide
auggaauacucuugguuacauga

SEQ ID NO: 1319 - RNA, 23 nt, Artificial Sequence
  Description of Artificial Sequence: Synthetic oligonucleotide
auggaauacucuugguuacauga

SEQ ID NO: 1320 - DNA, 23 bp, Artificial Sequence
  Description of Artificial Sequence: Synthetic oligonucleotide
  Description of Combined DNA/RNA Molecule: Synthetic oligonucleotide
auggaatacucuugguuacauga

SEQ ID NO: 1321 - DNA, 23 bp, Artificial Sequence
  Description of Artificial Sequence: Synthetic oligonucleotide
  Description of Combined DNA/RNA Molecule: Synthetic oligonucleotide
auggaatacucuugguuacauga

SEQ ID NO: 1322 - DNA, 23 bp, Artificial Sequence
  Description of Artificial Sequence: Synthetic oligonucleotide
  Description of Combined DNA/RNA Molecule: Synthetic oligonucleotide
auggaauacucuuggutacatga

SEQ ID NO: 1323 - DNA, 23 bp, Artificial Sequence
  Description of Artificial Sequence: Synthetic oligonucleotide
  Description of Combined DNA/RNA Molecule: Synthetic oligonucleotide
atggaauacucuugguuacauga

SEQ ID NO: 1324 - RNA, 23 nt, Artificial Sequence
  Description of Artificial Sequence: Synthetic oligonucleotide
auggaauacucuugguuacauga

SEQ ID NO: 1325 - DNA, 23 bp, Artificial Sequence
  Description of Artificial Sequence: Synthetic oligonucleotide
  Description of Combined DNA/RNA Molecule: Synthetic oligonucleotide
auggaauacucuugguuacauga

SEQ ID NO: 1326 - RNA, 23 nt, Artificial Sequence
  Description of Artificial Sequence: Synthetic oligonucleotide
auggaauacucuugguuacauga

SEQ ID NO: 1327 - RNA, 23 nt, Artificial Sequence
  Description of Artificial Sequence: Synthetic oligonucleotide
auggaauacucuugguuacauga

SEQ ID NO: 1328 - RNA, 23 nt, Artificial Sequence
  Description of Artificial Sequence: Synthetic oligonucleotide
auggaauacucuugguuacauga

SEQ ID NO: 1329 - RNA, 23 nt, Artificial Sequence
  Description of Artificial Sequence: Synthetic oligonucleotide
auggaauacucuugguuacauga

SEQ ID NO: 1330 - RNA, 23 nt, Artificial Sequence
  Description of Artificial Sequence: Synthetic oligonucleotide
auggaauacucuugguuacauga

SEQ ID NO: 1331 - RNA, 23 nt, Artificial Sequence
  Description of Artificial Sequence: Synthetic oligonucleotide
auggaauacucuugguuacauga

SEQ ID NO: 1332 - RNA, 23 nt, Artificial Sequence
  Description of Artificial Sequence: Synthetic oligonucleotide
auggaauacucuugguuacauga

SEQ ID NO: 1333 - RNA, 23 nt, Artificial Sequence
  Description of Artificial Sequence: Synthetic oligonucleotide
auggaauacucuugguuacaaga

SEQ ID NO: 1334 - DNA, 23 bp, Artificial Sequence
  Description of Artificial Sequence: Synthetic oligonucleotide
  Description of Combined DNA/RNA Molecule: Synthetic oligonucleotide
auggaauacucutgguuacauga

SEQ ID NO: 1335 - RNA, 23 nt, Artificial Sequence
  Description of Artificial Sequence: Synthetic oligonucleotide
auggaauacucuugguuacauga

SEQ ID NO: 1336 - DNA, 23 bp, Artificial Sequence
  Description of Artificial Sequence: Synthetic oligonucleotide
  Description of Combined DNA/RNA Molecule: Synthetic oligonucleotide
auggaauacuctugguuacauga

SEQ ID NO: 1337 - RNA, 23 nt, Artificial Sequence
  Description of Artificial Sequence: Synthetic oligonucleotide
auggaauacucuugguuacauga

SEQ ID NO: 1338 - RNA, 23 nt, Artificial Sequence
  Description of Artificial Sequence: Synthetic oligonucleotide
auggaauacucuugguuacauga

SEQ ID NO: 1339 - RNA, 23 nt, Artificial Sequence
  Description of Artificial Sequence: Synthetic oligonucleotide
auggaauacucuugguuacauga

SEQ ID NO: 1340 - RNA, 23 nt, Artificial Sequence
  Description of Artificial Sequence: Synthetic oligonucleotide
auggaauacucuugguuacauga

SEQ ID NO: 1341 - RNA, 23 nt, Artificial Sequence
  Description of Artificial Sequence: Synthetic oligonucleotide
auggaauacucuugguuacauga

SEQ ID NO: 1342 - RNA, 23 nt, Artificial Sequence
  Description of Artificial Sequence: Synthetic oligonucleotide
auggaauacucuugguuacauga

SEQ ID NO: 1343 - RNA, 23 nt, Artificial Sequence
  Description of Artificial Sequence: Synthetic oligonucleotide
auggaauacucuugguuacauga

SEQ ID NO: 1344 - RNA, 23 nt, Artificial Sequence
  Description of Artificial Sequence: Synthetic oligonucleotide
auggaauacucuugguuacauga

SEQ ID NO: 1345 - RNA, 23 nt, Artificial Sequence
  Description of Artificial Sequence: Synthetic oligonucleotide
auggaauacucuugguuacauga

SEQ ID NO: 1346 - RNA, 23 nt, Artificial Sequence
  Description of Artificial Sequence: Synthetic oligonucleotide
auggaauacucuugguuacauga

SEQ ID NO: 1347 - RNA, 23 nt, Artificial Sequence
  Description of Artificial Sequence: Synthetic oligonucleotide
auggaauacucuugguuacauga

SEQ ID NO: 1348 - RNA, 23 nt, Artificial Sequence
  Description of Artificial Sequence: Synthetic oligonucleotide
auggaauacucuugguuacauga

SEQ ID NO: 1349 - DNA, 23 bp, Artificial Sequence
  Description of Artificial Sequence: Synthetic oligonucleotide
  Description of Combined DNA/RNA Molecule: Synthetic oligonucleotide
auggaauacucuugguuacauga

SEQ ID NO: 1350 - DNA, 23 bp, Artificial Sequence
  Description of Artificial Sequence: Synthetic oligonucleotide
  Description of Combined DNA/RNA Molecule: Synthetic oligonucleotide
auggaauacucuugguuacauga

SEQ ID NO: 1351 - DNA, 23 bp, Artificial Sequence
  Description of Artificial Sequence: Synthetic oligonucleotide
  Description of Combined DNA/RNA Molecule: Synthetic oligonucleotide
auggaauacucuugguuacauga

SEQ ID NO: 1352 - DNA, 23 bp, Artificial Sequence
  Description of Artificial Sequence: Synthetic oligonucleotide
  Description of Combined DNA/RNA Molecule: Synthetic oligonucleotide
auggaatacucuugguuacauga

SEQ ID NO: 1353 - DNA, 23 bp, Artificial Sequence
  Description of Artificial Sequence: Synthetic oligonucleotide
  Description of Combined DNA/RNA Molecule: Synthetic oligonucleotide
auggaauacucuugguuacauga

SEQ ID NO: 1354 - DNA, 23 bp, Artificial Sequence
  Description of Artificial Sequence: Synthetic oligonucleotide
  Description of Combined DNA/RNA Molecule: Synthetic oligonucleotide
auggaatacucuugguuacauga

SEQ ID NO: 1355 - DNA, 23 bp, Artificial Sequence
  Description of Artificial Sequence: Synthetic oligonucleotide
  Description of Combined DNA/RNA Molecule: Synthetic oligonucleotide
auggaauacucuugguuacauga

SEQ ID NO: 1356 - DNA, 23 bp, Artificial Sequence
  Description of Artificial Sequence: Synthetic oligonucleotide
  Description of Combined DNA/RNA Molecule: Synthetic oligonucleotide
auggaatacucuugguuacauga

SEQ ID NO: 1357 - DNA, 23 bp, Artificial Sequence
  Description of Artificial Sequence: Synthetic oligonucleotide
  Description of Combined DNA/RNA Molecule: Synthetic oligonucleotide
atggaauacucuugguuacauga

SEQ ID NO: 1358 - DNA, 23 bp, Artificial Sequence
  Description of Artificial Sequence: Synthetic oligonucleotide
  Description of Combined DNA/RNA Molecule: Synthetic oligonucleotide
tuauagagcaagaacacuguuuu

SEQ ID NO: 1359 - RNA, 23 nt, Artificial Sequence
  Description of Artificial Sequence: Synthetic oligonucleotide
uuauagagcaagaacacuguuuu

SEQ ID NO: 1360 - RNA, 23 nt, Artificial Sequence
  Description of Artificial Sequence: Synthetic oligonucleotide
uuauagagcaagaacacuguuuu

SEQ ID NO: 1361 - RNA, 23 nt, Artificial Sequence
  Description of Artificial Sequence: Synthetic oligonucleotide
uuauagagcaagaacacuguuuu

SEQ ID NO: 1362 - DNA, 21 bp, Artificial Sequence
  Description of Artificial Sequence: Synthetic oligonucleotide
  Description of Combined DNA/RNA Molecule: Synthetic oligonucleotide
uuauagagcaagaacacugtt

SEQ ID NO: 1363 - RNA, 23 nt, Artificial Sequence
  Description of Artificial Sequence: Synthetic oligonucleotide
uuauagagcaagaacacuguuuu

SEQ ID NO: 1364 - RNA, 23 nt, Artificial Sequence
  Description of Artificial Sequence: Synthetic oligonucleotide
uuauagagcaagaacacuguuuu

SEQ ID NO: 1365 - RNA, 23 nt, Artificial Sequence
  Description of Artificial Sequence: Synthetic oligonucleotide
uuauagagcaagaacacuguuuu

SEQ ID NO: 1366 - RNA, 23 nt, Artificial Sequence
  Description of Artificial Sequence: Synthetic oligonucleotide
uuauagagcaagaacacuguuuu

SEQ ID NO: 1367 - RNA, 23 nt, Artificial Sequence
  Description of Artificial Sequence: Synthetic oligonucleotide
uuauagagcaagaacacuguuuu

SEQ ID NO: 1368 - RNA, 23 nt, Artificial Sequence
  Description of Artificial Sequence: Synthetic oligonucleotide
uuauagagcaagaacacuguuuu

SEQ ID NO: 1369 - RNA, 23 nt, Artificial Sequence
  Description of Artificial Sequence: Synthetic oligonucleotide
uuauagagcaagaacacuguuuu

SEQ ID NO: 1370 - RNA, 23 nt, Artificial Sequence
  Description of Artificial Sequence: Synthetic oligonucleotide
uuauagagcaagaacacuguuuu

SEQ ID NO: 1371 - RNA, 23 nt, Artificial Sequence
  Description of Artificial Sequence: Synthetic oligonucleotide
uuauagagcaagaacacuguuuu

SEQ ID NO: 1372 - RNA, 23 nt, Artificial Sequence
  Description of Artificial Sequence: Synthetic oligonucleotide
uuauagagcaagaacacuguuuu

SEQ ID NO: 1373 - DNA, 21 bp, Artificial Sequence
  Description of Artificial Sequence: Synthetic oligonucleotide
  Description of Combined DNA/RNA Molecule: Synthetic oligonucleotide
uuauagagcaagaacacugtt

SEQ ID NO: 1374 - RNA, 23 nt, Artificial Sequence
  Description of Artificial Sequence: Synthetic oligonucleotide
uuauagagcaagaacacuguuuu

SEQ ID NO: 1375 - RNA, 23 nt, Artificial Sequence
  Description of Artificial Sequence: Synthetic oligonucleotide
uuauagagcaagaacacuguuuu

SEQ ID NO: 1376 - RNA, 23 nt, Artificial Sequence
  Description of Artificial Sequence: Synthetic oligonucleotide
uuauagagcaagaacacuguuuu

SEQ ID NO: 1377 - DNA, 23 bp, Artificial Sequence
  Description of Artificial Sequence: Synthetic oligonucleotide
  Description of Combined DNA/RNA Molecule: Synthetic oligonucleotide
tuauagagcaagaacacaguuuu

SEQ ID NO: 1378 - RNA, 23 nt, Artificial Sequence
  Description of Artificial Sequence: Synthetic oligonucleotide
uuauagagcaagaacacuguuuu

SEQ ID NO: 1379 - DNA, 21 bp, Artificial Sequence
  Description of Artificial Sequence: Synthetic oligonucleotide
  Description of Combined DNA/RNA Molecule: Synthetic oligonucleotide
uuauagagcaagaacacugtt

SEQ ID NO: 1380 - RNA, 23 nt, Artificial Sequence
  Description of Artificial Sequence: Synthetic oligonucleotide
uuauagagcaagaacacuguuuu

SEQ ID NO: 1381 - RNA, 23 nt, Artificial Sequence
  Description of Artificial Sequence: Synthetic oligonucleotide
uuauagagcaagaacacuguuuu

SEQ ID NO: 1382 - DNA, 21 bp, Artificial Sequence
  Description of Artificial Sequence: Synthetic oligonucleotide
  Description of Combined DNA/RNA Molecule: Synthetic oligonucleotide
uuauagagcaagaacacugtt

SEQ ID NO: 1383 - RNA, 23 nt, Artificial Sequence
  Description of Artificial Sequence: Synthetic oligonucleotide
uuauagagcaagaacacuguuuu

SEQ ID NO: 1384 - RNA, 23 nt, Artificial Sequence
  Description of Artificial Sequence: Synthetic oligonucleotide
uuauagagcaagaacacuguuuu

SEQ ID NO: 1385 - DNA, 21 bp, Artificial Sequence
  Description of Artificial Sequence: Synthetic oligonucleotide
  Description of Combined DNA/RNA Molecule: Synthetic oligonucleotide
uuauagagcaagaacacugtt

SEQ ID NO: 1386 - RNA, 23 nt, Artificial Sequence
  Description of Artificial Sequence: Synthetic oligonucleotide
uuauagagcaagaacacuguuuu

SEQ ID NO: 1387 - RNA, 23 nt, Artificial Sequence
  Description of Artificial Sequence: Synthetic oligonucleotide
uuauagagcaagaacacuguuuu

SEQ ID NO: 1388 - RNA, 23 nt, Artificial Sequence
  Description of Artificial Sequence: Synthetic oligonucleotide
uuauagagcaagaacacuguuuu

SEQ ID NO: 1389 - DNA, 21 bp, Artificial Sequence
  Description of Artificial Sequence: Synthetic oligonucleotide
  Description of Combined DNA/RNA Molecule: Synthetic oligonucleotide
uuauagagcaagaacacugtt

SEQ ID NO: 1390 - RNA, 23 nt, Artificial Sequence
  Description of Artificial Sequence: Synthetic oligonucleotide
uuauagagcaagaacacuguuuu

SEQ ID NO: 1391 - RNA, 23 nt, Artificial Sequence
  Description of Artificial Sequence: Synthetic oligonucleotide
uuauagagcaagaacacuguuuu

SEQ ID NO: 1392 - RNA, 23 nt, Artificial Sequence
  Description of Artificial Sequence: Synthetic oligonucleotide
uuauagagcaagaacacuguuuu

SEQ ID NO: 1393 - RNA, 23 nt, Artificial Sequence
  Description of Artificial Sequence: Synthetic oligonucleotide
uuauagagcaagaacacuguuuu

SEQ ID NO: 1394 - RNA, 23 nt, Artificial Sequence
  Description of Artificial Sequence: Synthetic oligonucleotide
uuauagagcaagaacacuguuuu

SEQ ID NO: 1395 - RNA, 23 nt, Artificial Sequence
  Description of Artificial Sequence: Synthetic oligonucleotide
uuauagagcaagaacacuguuuu

SEQ ID NO: 1396 - RNA, 23 nt, Artificial Sequence
  Description of Artificial Sequence: Synthetic oligonucleotide
uuauagagcaagaacacuguuuu

SEQ ID NO: 1397 - RNA, 23 nt, Artificial Sequence
  Description of Artificial Sequence: Synthetic oligonucleotide
uuauagagcaagaacacuguuuu

SEQ ID NO: 1398 - RNA, 23 nt, Artificial Sequence
  Description of Artificial Sequence: Synthetic oligonucleotide
uuauagagcaagaacacuguuuu

SEQ ID NO: 1399 - RNA, 23 nt, Artificial Sequence
  Description of Artificial Sequence: Synthetic oligonucleotide
uuauagagcaagaacacuguuuu

SEQ ID NO: 1400 - RNA, 23 nt, Artificial Sequence
  Description of Artificial Sequence: Synthetic oligonucleotide
uuauagagcaagaacacuguuuu

SEQ ID NO: 1401 - RNA, 23 nt, Artificial Sequence
  Description of Artificial Sequence: Synthetic oligonucleotide
uuauagagcaagaacacuguuuu

SEQ ID NO: 1402 - RNA, 23 nt, Artificial Sequence
  Description of Artificial Sequence: Synthetic oligonucleotide
uuauagagcaagaacacuguuuu

SEQ ID NO: 1403 - RNA, 23 nt, Artificial Sequence
  Description of Artificial Sequence: Synthetic oligonucleotide
uuauagagcaagaacacuguuuu

SEQ ID NO: 1404 - RNA, 23 nt, Artificial Sequence
  Description of Artificial Sequence: Synthetic oligonucleotide
uuauagagcaagaacacuguuuu

SEQ ID NO: 1405 - RNA, 23 nt, Artificial Sequence
  Description of Artificial Sequence: Synthetic oligonucleotide
uuauagagcaagaacacuguuuu

SEQ ID NO: 1406 - DNA, 23 bp, Artificial Sequence
  Description of Artificial Sequence: Synthetic oligonucleotide
  Description of Combined DNA/RNA Molecule: Synthetic oligonucleotide
ttauagagcaagaacactguttu

SEQ ID NO: 1407 - RNA, 23 nt, Artificial Sequence
  Description of Artificial Sequence: Synthetic oligonucleotide
uuauagagcaagaacacuguuuu

SEQ ID NO: 1408 - RNA, 23 nt, Artificial Sequence
  Description of Artificial Sequence: Synthetic oligonucleotide
uuauagagcaagaacacuguuuu

SEQ ID NO: 1409 - RNA, 23 nt, Artificial Sequence
  Description of Artificial Sequence: Synthetic oligonucleotide
uuauagagcaagaacacuguuuu

SEQ ID NO: 1410 - RNA, 23 nt, Artificial Sequence
  Description of Artificial Sequence: Synthetic oligonucleotide
uuauagagcaagaacacuguuuu

SEQ ID NO: 1411 - RNA, 23 nt, Artificial Sequence
  Description of Artificial Sequence: Synthetic oligonucleotide
uuauagagcaagaacacuguuuu

SEQ ID NO: 1412 - RNA, 23 nt, Artificial Sequence
  Description of Artificial Sequence: Synthetic oligonucleotide
uuauagagcaagaacacuguuuu

SEQ ID NO: 1413 - RNA, 23 nt, Artificial Sequence
  Description of Artificial Sequence: Synthetic oligonucleotide
uuauagagcaagaacacuguuuu

SEQ ID NO: 1414 - RNA, 23 nt, Artificial Sequence
  Description of Artificial Sequence: Synthetic oligonucleotide
uuauagagcaagaacacuguuuu

SEQ ID NO: 1415 - DNA, 23 bp, Artificial Sequence
  Description of Artificial Sequence: Synthetic oligonucleotide
  Description of Combined DNA/RNA Molecule: Synthetic oligonucleotide
utatagagcaagaacacugttuu

SEQ ID NO: 1416 - DNA, 23 bp, Artificial Sequence
  Description of Artificial Sequence: Synthetic oligonucleotide
  Description of Combined DNA/RNA Molecule: Synthetic oligonucleotide
tuauagagcaagaacacuguuuu

SEQ ID NO: 1417 - DNA, 23 bp, Artificial Sequence
  Description of Artificial Sequence: Synthetic oligonucleotide
  Description of Combined DNA/RNA Molecule: Synthetic oligonucleotide
tuauagagcaagaacacuguuuu

SEQ ID NO: 1418 - DNA, 23 bp, Artificial Sequence
  Description of Artificial Sequence: Synthetic oligonucleotide
  Description of Combined DNA/RNA Molecule: Synthetic oligonucleotide
tuauagagcaagaacacuguuuu

SEQ ID NO: 1419 - DNA, 23 bp, Artificial Sequence
  Description of Artificial Sequence: Synthetic oligonucleotide
  Description of Combined DNA/RNA Molecule: Synthetic oligonucleotide
tuauagagcaagaacacuguuuu

SEQ ID NO: 1420 - DNA, 23 bp, Artificial Sequence
  Description of Artificial Sequence: Synthetic oligonucleotide
  Description of Combined DNA/RNA Molecule: Synthetic oligonucleotide
tuauagagcaagaacacaguuuu

SEQ ID NO: 1421 - DNA, 23 bp, Artificial Sequence
  Description of Artificial Sequence: Synthetic oligonucleotide
  Description of Combined DNA/RNA Molecule: Synthetic oligonucleotide
ttatagagcaagaacacaguuuu

SEQ ID NO: 1422 - DNA, 23 bp, Artificial Sequence
  Description of Artificial Sequence: Synthetic oligonucleotide
  Description of Combined DNA/RNA Molecule: Synthetic oligonucleotide
tuauagagcaagaacacuguuuu

SEQ ID NO: 1423 - RNA, 23 nt, Artificial Sequence
  Description of Artificial Sequence: Synthetic oligonucleotide
uuauagagcaagaacacuguuuu

SEQ ID NO: 1424 - RNA, 23 nt, Artificial Sequence
  Description of Artificial Sequence: Synthetic oligonucleotide
uuauagagcaagaacacuguuuu

SEQ ID NO: 1425 - RNA, 23 nt, Artificial Sequence
  Description of Artificial Sequence: Synthetic oligonucleotide
uuauagagcaagaacacuguuuu

SEQ ID NO: 1426 - RNA, 23 nt, Artificial Sequence
  Description of Artificial Sequence: Synthetic oligonucleotide
uuauagagcaagaacacuguuuu

SEQ ID NO: 1427 - RNA, 23 nt, Artificial Sequence
  Description of Artificial Sequence: Synthetic oligonucleotide
uuauagagcaagaacacuguuuu

SEQ ID NO: 1428 - RNA, 23 nt, Artificial Sequence
  Description of Artificial Sequence: Synthetic oligonucleotide
uuauagagcaagaacacuguuuu

SEQ ID NO: 1429 - RNA, 23 nt, Artificial Sequence
  Description of Artificial Sequence: Synthetic oligonucleotide
uuauagagcaagaacacuguuuu

SEQ ID NO: 1430 - RNA, 23 nt, Artificial Sequence
  Description of Artificial Sequence: Synthetic oligonucleotide
uuauagagcaagaacacuguuuu

SEQ ID NO: 1431 - RNA, 23 nt, Artificial Sequence
  Description of Artificial Sequence: Synthetic oligonucleotide
uuauagagcaagaacacuguuuu

SEQ ID NO: 1432 - RNA, 23 nt, Artificial Sequence
  Description of Artificial Sequence: Synthetic oligonucleotide
uuauagagcaagaacacuguuuu

SEQ ID NO: 1433 - RNA, 23 nt, Artificial Sequence
  Description of Artificial Sequence: Synthetic oligonucleotide
uuauagagcaagaacacuguuuu

SEQ ID NO: 1434 - RNA, 23 nt, Artificial Sequence
  Description of Artificial Sequence: Synthetic oligonucleotide
uuauagagcaagaacacuguuuu

SEQ ID NO: 1435 - RNA, 23 nt, Artificial Sequence
  Description of Artificial Sequence: Synthetic oligonucleotide
uuauagagcaagaacacuguuuu

SEQ ID NO: 1436 - RNA, 23 nt, Artificial Sequence
  Description of Artificial Sequence: Synthetic oligonucleotide
uuauagagcaagaacacuguuuu

SEQ ID NO: 1437 - RNA, 23 nt, Artificial Sequence
  Description of Artificial Sequence: Synthetic oligonucleotide
uuauagagcaagaacacuguuuu

SEQ ID NO: 1438 - RNA, 23 nt, Artificial Sequence
  Description of Artificial Sequence: Synthetic oligonucleotide
uuauagagcaagaacacuguuuu

SEQ ID NO: 1439 - RNA, 23 nt, Artificial Sequence
  Description of Artificial Sequence: Synthetic oligonucleotide
uuauagagcaagaacacuguuuu

SEQ ID NO: 1440 - RNA, 23 nt, Artificial Sequence
  Description of Artificial Sequence: Synthetic oligonucleotide
uuauagagcaagaacacuguuuu

SEQ ID NO: 1441 - RNA, 23 nt, Artificial Sequence
  Description of Artificial Sequence: Synthetic oligonucleotide
uuauagagcaagaacacuguuuu

SEQ ID NO: 1442 - RNA, 23 nt, Artificial Sequence
  Description of Artificial Sequence: Synthetic oligonucleotide
uuauagagcaagaacacuguuuu

SEQ ID NO: 1443 - RNA, 23 nt, Artificial Sequence
  Description of Artificial Sequence: Synthetic oligonucleotide
uuauagagcaagaacacuguuuu

SEQ ID NO: 1444 - RNA, 23 nt, Artificial Sequence
  Description of Artificial Sequence: Synthetic oligonucleotide
uuauagagcaagaacacuguuuu

SEQ ID NO: 1445 - RNA, 23 nt, Artificial Sequence
  Description of Artificial Sequence: Synthetic oligonucleotide
uuauagagcaagaacacuguuuu

SEQ ID NO: 1446 - RNA, 23 nt, Artificial Sequence
  Description of Artificial Sequence: Synthetic oligonucleotide
uuauagagcaagaacacuguuuu

SEQ ID NO: 1447 - RNA, 23 nt, Artificial Sequence
  Description of Artificial Sequence: Synthetic oligonucleotide
uuauagagcaagaacacuguuuu

SEQ ID NO: 1448 - RNA, 23 nt, Artificial Sequence
  Description of Artificial Sequence: Synthetic oligonucleotide
uuauagagcaagaacacuguuuu

SEQ ID NO: 1449 - RNA, 23 nt, Artificial Sequence
  Description of Artificial Sequence: Synthetic oligonucleotide
uuauagagcaagaacacuguuuu

SEQ ID NO: 1450 - RNA, 23 nt, Artificial Sequence
  Description of Artificial Sequence: Synthetic oligonucleotide
uuauagagcaagaacacuguuuu

SEQ ID NO: 1451 - RNA, 23 nt, Artificial Sequence
  Description of Artificial Sequence: Synthetic oligonucleotide
uuauagagcaagaacacuguuuu

SEQ ID NO: 1452 - RNA, 23 nt, Artificial Sequence
  Description of Artificial Sequence: Synthetic oligonucleotide
uuauagagcaagaacacuguuuu

SEQ ID NO: 1453 - RNA, 23 nt, Artificial Sequence
  Description of Artificial Sequence: Synthetic oligonucleotide
uuauagagcaagaacacuguuuu

SEQ ID NO: 1454 - RNA, 23 nt, Artificial Sequence
  Description of Artificial Sequence: Synthetic oligonucleotide
uuauagagcaagaacacuguuuu

SEQ ID NO: 1455 - RNA, 23 nt, Artificial Sequence
  Description of Artificial Sequence: Synthetic oligonucleotide
uuauagagcaagaacacuguuuu

SEQ ID NO: 1456 - RNA, 23 nt, Artificial Sequence
  Description of Artificial Sequence: Synthetic oligonucleotide
uuauagagcaagaacacuguuuu

SEQ ID NO: 1457 - RNA, 23 nt, Artificial Sequence
  Description of Artificial Sequence: Synthetic oligonucleotide
uuauagagcaagaacacuguuuu

SEQ ID NO: 1458 - RNA, 23 nt, Artificial Sequence
  Description of Artificial Sequence: Synthetic oligonucleotide
uuauagagcaagaacacuguuuu

SEQ ID NO: 1459 - RNA, 23 nt, Artificial Sequence
  Description of Artificial Sequence: Synthetic oligonucleotide
uuauagagcaagaacacuguuuu

SEQ ID NO: 1460 - RNA, 23 nt, Artificial Sequence
  Description of Artificial Sequence: Synthetic oligonucleotide
uuauagagcaagaacacuguuuu

SEQ ID NO: 1461 - RNA, 23 nt, Artificial Sequence
  Description of Artificial Sequence: Synthetic oligonucleotide
uuauagagcaagaacacuguuuu

SEQ ID NO: 1462 - RNA, 23 nt, Artificial Sequence
  Description of Artificial Sequence: Synthetic oligonucleotide
uuauagagcaagaacacuguuuu

SEQ ID NO: 1463 - RNA, 23 nt, Artificial Sequence
  Description of Artificial Sequence: Synthetic oligonucleotide
uuauagagcaagaacacuguuuu

SEQ ID NO: 1464 - RNA, 23 nt, Artificial Sequence
  Description of Artificial Sequence: Synthetic oligonucleotide
uuauagagcaagaacacuguuuu

SEQ ID NO: 1465 - RNA, 23 nt, Artificial Sequence
  Description of Artificial Sequence: Synthetic oligonucleotide
uuauagagcaagaacacuguuuu

SEQ ID NO: 1466 - RNA, 23 nt, Artificial Sequence
  Description of Artificial Sequence: Synthetic oligonucleotide
uuauagagcaagaacacuguuuu

SEQ ID NO: 1467 - RNA, 23 nt, Artificial Sequence
  Description of Artificial Sequence: Synthetic oligonucleotide
uuauagagcaagaacacuguuuu

SEQ ID NO: 1468 - RNA, 23 nt, Artificial Sequence
  Description of Artificial Sequence: Synthetic oligonucleotide
uuauagagcaagaacacuguuuu

SEQ ID NO: 1469 - RNA, 23 nt, Artificial Sequence
  Description of Artificial Sequence: Synthetic oligonucleotide
uuauagagcaagaacacuguuuu

SEQ ID NO: 1470 - RNA, 23 nt, Artificial Sequence
  Description of Artificial Sequence: Synthetic oligonucleotide
uuauagagcaagaacacuguuuu

SEQ ID NO: 1471 - RNA, 23 nt, Artificial Sequence
  Description of Artificial Sequence: Synthetic oligonucleotide
uuauagagcaagaacacuguuuu

SEQ ID NO: 1472 - RNA, 23 nt, Artificial Sequence
  Description of Artificial Sequence: Synthetic oligonucleotide
uuauagagcaagaacacuguuuu

SEQ ID NO: 1473 - RNA, 23 nt, Artificial Sequence
  Description of Artificial Sequence: Synthetic oligonucleotide
uuauagagcaagaacacuguuuu

SEQ ID NO: 1474 - RNA, 23 nt, Artificial Sequence
  Description of Artificial Sequence: Synthetic oligonucleotide
uuauagagcaagaacacuguuuu

SEQ ID NO: 1475 - RNA, 23 nt, Artificial Sequence
  Description of Artificial Sequence: Synthetic oligonucleotide
uuauagagcaagaacacuguuuu

SEQ ID NO: 1476 - RNA, 23 nt, Artificial Sequence
  Description of Artificial Sequence: Synthetic oligonucleotide
uuauagagcaagaacacuguuuu

SEQ ID NO: 1477 - RNA, 23 nt, Artificial Sequence
  Description of Artificial Sequence: Synthetic oligonucleotide
uuauagagcaagaacacuguuuu

SEQ ID NO: 1478 - RNA, 23 nt, Artificial Sequence
  Description of Artificial Sequence: Synthetic oligonucleotide
uuauagagcaagaacacuguuuu

SEQ ID NO: 1479 - RNA, 23 nt, Artificial Sequence
  Description of Artificial Sequence: Synthetic oligonucleotide
uuauagagcaagaacacuguuuu

SEQ ID NO: 1480 - RNA, 23 nt, Artificial Sequence
  Description of Artificial Sequence: Synthetic oligonucleotide
uuauagagcaagaacacuguuuu

SEQ ID NO: 1481 - RNA, 23 nt, Artificial Sequence
  Description of Artificial Sequence: Synthetic oligonucleotide
uuauagagcaagaacacuguuuu

SEQ ID NO: 1482 - RNA, 23 nt, Artificial Sequence
  Description of Artificial Sequence: Synthetic oligonucleotide
uuauagagcaagaacacuguuuu

SEQ ID NO: 1483 - RNA, 23 nt, Artificial Sequence
  Description of Artificial Sequence: Synthetic oligonucleotide
uuauagagcaagaacacuguuuu

SEQ ID NO: 1484 - RNA, 23 nt, Artificial Sequence
  Description of Artificial Sequence: Synthetic oligonucleotide
uuauagagcaagaacacuguuuu

SEQ ID NO: 1485 - RNA, 23 nt, Artificial Sequence
  Description of Artificial Sequence: Synthetic oligonucleotide
uuauagagcaagaacacuguuuu

SEQ ID NO: 1486 - RNA, 23 nt, Artificial Sequence
  Description of Artificial Sequence: Synthetic oligonucleotide
uuauagagcaagaacacuguuuu

SEQ ID NO: 1487 - RNA, 23 nt, Artificial Sequence
  Description of Artificial Sequence: Synthetic oligonucleotide
uuauagagcaagaacacuguuuu

SEQ ID NO: 1488 - RNA, 23 nt, Artificial Sequence
  Description of Artificial Sequence: Synthetic oligonucleotide
uuauagagcaagaacacuguuuu

SEQ ID NO: 1489 - RNA, 23 nt, Artificial Sequence
  Description of Artificial Sequence: Synthetic oligonucleotide
uuauagagcaagaacacuguuuu

SEQ ID NO: 1490 - RNA, 23 nt, Artificial Sequence
  Description of Artificial Sequence: Synthetic oligonucleotide
uuauagagcaagaacacuguuuu

SEQ ID NO: 1491 - RNA, 23 nt, Artificial Sequence
  Description of Artificial Sequence: Synthetic oligonucleotide
uuauagagcaagaacacuguuuu

SEQ ID NO: 1492 - RNA, 23 nt, Artificial Sequence
  Description of Artificial Sequence: Synthetic oligonucleotide
uuauagagcaagaacacuguuuu

SEQ ID NO: 1493 - RNA, 23 nt, Artificial Sequence
  Description of Artificial Sequence: Synthetic oligonucleotide
uuauagagcaagaacacuguuuu

SEQ ID NO: 1494 - RNA, 23 nt, Artificial Sequence
  Description of Artificial Sequence: Synthetic oligonucleotide
uuauagagcaagaacacuguuuu

SEQ ID NO: 1495 - RNA, 23 nt, Artificial Sequence
  Description of Artificial Sequence: Synthetic oligonucleotide
uuauagagcaagaacacuguuuu

SEQ ID NO: 1496 - DNA, 23 bp, Artificial Sequence
  Description of Artificial Sequence: Synthetic oligonucleotide
  Description of Combined DNA/RNA Molecule: Synthetic oligonucleotide
uuauagagcaagaacacugttuu

SEQ ID NO: 1497 - RNA, 23 nt, Artificial Sequence
  Description of Artificial Sequence: Synthetic oligonucleotide
uuauagagcaagaacacuguuuu

SEQ ID NO: 1498 - RNA, 23 nt, Artificial Sequence
  Description of Artificial Sequence: Synthetic oligonucleotide
uuauagagcaagaacacuguuuu

SEQ ID NO: 1499 - RNA, 23 nt, Artificial Sequence
  Description of Artificial Sequence: Synthetic oligonucleotide
uuauagagcaagaacacuguuuu

SEQ ID NO: 1500 - RNA, 23 nt, Artificial Sequence
  Description of Artificial Sequence: Synthetic oligonucleotide
uuauagagcaagaacacuguuuu

SEQ ID NO: 1501 - DNA, 23 bp, Artificial Sequence
  Description of Artificial Sequence: Synthetic oligonucleotide
  Description of Combined DNA/RNA Molecule: Synthetic oligonucleotide
uuauagagcaagaacacugutuu

SEQ ID NO: 1502 - RNA, 23 nt, Artificial Sequence
  Description of Artificial Sequence: Synthetic oligonucleotide
uuauagagcaagaacacuguuuu

SEQ ID NO: 1503 - RNA, 23 nt, Artificial Sequence
  Description of Artificial Sequence: Synthetic oligonucleotide
uuauagagcaagaacacuguuuu

SEQ ID NO: 1504 - RNA, 23 nt, Artificial Sequence
  Description of Artificial Sequence: Synthetic oligonucleotide
uuauagagcaagaacacuguuuu

SEQ ID NO: 1505 - RNA, 23 nt, Artificial Sequence
  Description of Artificial Sequence: Synthetic oligonucleotide
uuauagagcaagaacacuguuuu

SEQ ID NO: 1506 - RNA, 23 nt, Artificial Sequence
  Description of Artificial Sequence: Synthetic oligonucleotide
uuauagagcaagaacacuguuuu

SEQ ID NO: 1507 - DNA, 23 bp, Artificial Sequence
  Description of Artificial Sequence: Synthetic oligonucleotide
  Description of Combined DNA/RNA Molecule: Synthetic oligonucleotide
uuatagagcaagagcacaguuuu

SEQ ID NO: 1508 - RNA, 23 nt, Artificial Sequence
  Description of Artificial Sequence: Synthetic oligonucleotide
uuauagagcaagaacacuguuuu

SEQ ID NO: 1509 - DNA, 23 bp, Artificial Sequence
  Description of Artificial Sequence: Synthetic oligonucleotide
  Description of Combined DNA/RNA Molecule: Synthetic oligonucleotide
utatagagcaagaacactgtutu

SEQ ID NO: 1510 - DNA, 23 bp, Artificial Sequence
  Description of Artificial Sequence: Synthetic oligonucleotide
  Description of Combined DNA/RNA Molecule: Synthetic oligonucleotide
uuauagagcaagagcacaguuuu

SEQ ID NO: 1511 - DNA, 23 bp, Artificial Sequence
  Description of Artificial Sequence: Synthetic oligonucleotide
  Description of Combined DNA/RNA Molecule: Synthetic oligonucleotide
uuauagagcaagagcacaguuuu

SEQ ID NO: 1512 - RNA, 23 nt, Artificial Sequence
  Description of Artificial Sequence: Synthetic oligonucleotide
uuauagagcaagaacacuguuuu

SEQ ID NO: 1513 - DNA, 23 bp, Artificial Sequence
  Description of Artificial Sequence: Synthetic oligonucleotide
  Description of Combined DNA/RNA Molecule: Synthetic oligonucleotide
utauagagcaagagcacaguuuu

SEQ ID NO: 1514 - RNA, 23 nt, Artificial Sequence
  Description of Artificial Sequence: Synthetic oligonucleotide
uuauagagcaagaacacuguuuu

SEQ ID NO: 1515 - RNA, 23 nt, Artificial Sequence
  Description of Artificial Sequence: Synthetic oligonucleotide
uuauagagcaagaacacuguuuu

SEQ ID NO: 1516 - DNA, 23 bp, Artificial Sequence
  Description of Artificial Sequence: Synthetic oligonucleotide
  Description of Combined DNA/RNA Molecule: Synthetic oligonucleotide
utauagagcaagagcacaguuuu

SEQ ID NO: 1517 - RNA, 23 nt, Artificial Sequence
  Description of Artificial Sequence: Synthetic oligonucleotide
uuauagagcaagaacacuguuuu

SEQ ID NO: 1518 - DNA, 23 bp, Artificial Sequence
  Description of Artificial Sequence: Synthetic oligonucleotide
  Description of Combined DNA/RNA Molecule: Synthetic oligonucleotide
utatagagcaagaacacaguuuu

SEQ ID NO: 1519 - RNA, 23 nt, Artificial Sequence
  Description of Artificial Sequence: Synthetic oligonucleotide
uuauagagcaagaacacuguuuu

SEQ ID NO: 1520 - DNA, 23 bp, Artificial Sequence
  Description of Artificial Sequence: Synthetic oligonucleotide
  Description of Combined DNA/RNA Molecule: Synthetic oligonucleotide
utatagagcaagagcacaguuuu

SEQ ID NO: 1521 - RNA, 23 nt, Artificial Sequence
  Description of Artificial Sequence: Synthetic oligonucleotide
uuauagagcaagaacacuguuuu

SEQ ID NO: 1522 - DNA, 23 bp, Artificial Sequence
  Description of Artificial Sequence: Synthetic oligonucleotide
  Description of Combined DNA/RNA Molecule: Synthetic oligonucleotide
utatagagcaagaacacugttuu

SEQ ID NO: 1523 - RNA, 23 nt, Artificial Sequence
  Description of Artificial Sequence: Synthetic oligonucleotide
uuauagagcaagaacacuguuuu

SEQ ID NO: 1524 - RNA, 23 nt, Artificial Sequence
  Description of Artificial Sequence: Synthetic oligonucleotide
uuauagagcaagaacacuguuuu

SEQ ID NO: 1525 - RNA, 23 nt, Artificial Sequence
  Description of Artificial Sequence: Synthetic oligonucleotide
uuauagagcaagaacacuguuuu

SEQ ID NO: 1526 - RNA, 23 nt, Artificial Sequence
  Description of Artificial Sequence: Synthetic oligonucleotide
uuauagagcaagaacacuguuuu

SEQ ID NO: 1527 - RNA, 23 nt, Artificial Sequence
  Description of Artificial Sequence: Synthetic oligonucleotide
uuauagagcaagaacacuguuuu

SEQ ID NO: 1528 - RNA, 23 nt, Artificial Sequence
  Description of Artificial Sequence: Synthetic oligonucleotide
uuauagagcaagaacacuguuuu

SEQ ID NO: 1529 - RNA, 23 nt, Artificial Sequence
  Description of Artificial Sequence: Synthetic oligonucleotide
uuauagagcaagaacacuguuuu

SEQ ID NO: 1530 - RNA, 23 nt, Artificial Sequence
  Description of Artificial Sequence: Synthetic oligonucleotide
agguccacuggaggagaaguccc

SEQ ID NO: 1531 - RNA, 23 nt, Artificial Sequence
  Description of Artificial Sequence: Synthetic oligonucleotide
agguccacuggaggagaaguccc

SEQ ID NO: 1532 - RNA, 23 nt, Artificial Sequence
  Description of Artificial Sequence: Synthetic oligonucleotide
cagguccacuggaggagaagucc

SEQ ID NO: 1533 - RNA, 23 nt, Artificial Sequence
  Description of Artificial Sequence: Synthetic oligonucleotide
cagguccacuggaggagaagucc

SEQ ID NO: 1534 - RNA, 23 nt, Artificial Sequence
  Description of Artificial Sequence: Synthetic oligonucleotide
ucagguccacuggaggagaaguc

SEQ ID NO: 1535 - RNA, 23 nt, Artificial Sequence
  Description of Artificial Sequence: Synthetic oligonucleotide
ucagguccacuggaggagaaguc

SEQ ID NO: 1536 - RNA, 23 nt, Artificial Sequence
  Description of Artificial Sequence: Synthetic oligonucleotide
uucagguccacuggaggagaagu

SEQ ID NO: 1537 - RNA, 23 nt, Artificial Sequence
  Description of Artificial Sequence: Synthetic oligonucleotide
uucagguccacuggaggagaagu

SEQ ID NO: 1538 - RNA, 23 nt, Artificial Sequence
  Description of Artificial Sequence: Synthetic oligonucleotide
cuucagguccacuggaggagaag

SEQ ID NO: 1539 - RNA, 23 nt, Artificial Sequence
  Description of Artificial Sequence: Synthetic oligonucleotide
cuucagguccacuggaggagaag

SEQ ID NO: 1540 - RNA, 23 nt, Artificial Sequence
  Description of Artificial Sequence: Synthetic oligonucleotide
ccuucagguccacuggaggagaa

SEQ ID NO: 1541 - RNA, 23 nt, Artificial Sequence
  Description of Artificial Sequence: Synthetic oligonucleotide
ccuucagguccacuggaggagaa

SEQ ID NO: 1542 - RNA, 23 nt, Artificial Sequence
  Description of Artificial Sequence: Synthetic oligonucleotide
uccuucagguccacuggaggaga

SEQ ID NO: 1543 - RNA, 23 nt, Artificial Sequence
  Description of Artificial Sequence: Synthetic oligonucleotide
uccuucagguccacuggaggaga

SEQ ID NO: 1544 - RNA, 23 nt, Artificial Sequence
  Description of Artificial Sequence: Synthetic oligonucleotide
guccuucagguccacuggaggag

SEQ ID NO: 1545 - RNA, 23 nt, Artificial Sequence
  Description of Artificial Sequence: Synthetic oligonucleotide
guccuucagguccacuggaggag

SEQ ID NO: 1546 - RNA, 23 nt, Artificial Sequence
  Description of Artificial Sequence: Synthetic oligonucleotide
cguccuucagguccacuggagga

SEQ ID NO: 1547 - RNA, 23 nt, Artificial Sequence
  Description of Artificial Sequence: Synthetic oligonucleotide
cguccuucagguccacuggagga

SEQ ID NO: 1548 - RNA, 23 nt, Artificial Sequence
  Description of Artificial Sequence: Synthetic oligonucleotide
ucguccuucagguccacuggagg

SEQ ID NO: 1549 - RNA, 23 nt, Artificial Sequence
  Description of Artificial Sequence: Synthetic oligonucleotide
ucguccuucagguccacuggagg

SEQ ID NO: 1550 - RNA, 23 nt, Artificial Sequence
  Description of Artificial Sequence: Synthetic oligonucleotide
cucguccuucagguccacuggag

SEQ ID NO: 1551 - RNA, 23 nt, Artificial Sequence
  Description of Artificial Sequence: Synthetic oligonucleotide
cucguccuucagguccacuggag

SEQ ID NO: 1552 - RNA, 23 nt, Artificial Sequence
  Description of Artificial Sequence: Synthetic oligonucleotide
ccucguccuucagguccacugga

SEQ ID NO: 1553 - RNA, 23 nt, Artificial Sequence
  Description of Artificial Sequence: Synthetic oligonucleotide
ccucguccuucagguccacugga

SEQ ID NO: 1554 - RNA, 23 nt, Artificial Sequence
  Description of Artificial Sequence: Synthetic oligonucleotide
cccucguccuucagguccacugg

SEQ ID NO: 1555 - RNA, 23 nt, Artificial Sequence
  Description of Artificial Sequence: Synthetic oligonucleotide
cccucguccuucagguccacugg

SEQ ID NO: 1556 - RNA, 23 nt, Artificial Sequence
  Description of Artificial Sequence: Synthetic oligonucleotide
ucccucguccuucagguccacug

SEQ ID NO: 1557 - RNA, 23 nt, Artificial Sequence
  Description of Artificial Sequence: Synthetic oligonucleotide
ucccucguccuucagguccacug

SEQ ID NO: 1558 - RNA, 23 nt, Artificial Sequence
  Description of Artificial Sequence: Synthetic oligonucleotide
aucccucguccuucagguccacu

SEQ ID NO: 1559 - RNA, 23 nt, Artificial Sequence
  Description of Artificial Sequence: Synthetic oligonucleotide
aucccucguccuucagguccacu

SEQ ID NO: 1560 - RNA, 23 nt, Artificial Sequence
  Description of Artificial Sequence: Synthetic oligonucleotide
caucccucguccuucagguccac

SEQ ID NO: 1561 - RNA, 23 nt, Artificial Sequence
  Description of Artificial Sequence: Synthetic oligonucleotide
caucccucguccuucagguccac

SEQ ID NO: 1562 - RNA, 23 nt, Artificial Sequence
  Description of Artificial Sequence: Synthetic oligonucleotide
ccaucccucguccuucaggucca

SEQ ID NO: 1563 - RNA, 23 nt, Artificial Sequence
  Description of Artificial Sequence: Synthetic oligonucleotide
ccaucccucguccuucaggucca

SEQ ID NO: 1564 - RNA, 23 nt, Artificial Sequence
  Description of Artificial Sequence: Synthetic oligonucleotide
cccaucccucguccuucaggucc

SEQ ID NO: 1565 - RNA, 23 nt, Artificial Sequence
  Description of Artificial Sequence: Synthetic oligonucleotide
cccaucccucguccuucaggucc

SEQ ID NO: 1566 - RNA, 23 nt, Artificial Sequence
  Description of Artificial Sequence: Synthetic oligonucleotide
ucccaucccucguccuucagguc

SEQ ID NO: 1567 - RNA, 23 nt, Artificial Sequence
  Description of Artificial Sequence: Synthetic oligonucleotide
ucccaucccucguccuucagguc

SEQ ID NO: 1568 - RNA, 23 nt, Artificial Sequence
  Description of Artificial Sequence: Synthetic oligonucleotide
aucccaucccucguccuucaggu

SEQ ID NO: 1569 - RNA, 23 nt, Artificial Sequence
  Description of Artificial Sequence: Synthetic oligonucleotide
aucccaucccucguccuucaggu

SEQ ID NO: 1570 - RNA, 23 nt, Artificial Sequence
  Description of Artificial Sequence: Synthetic oligonucleotide
aaucccaucccucguccuucagg

SEQ ID NO: 1571 - RNA, 23 nt, Artificial Sequence
  Description of Artificial Sequence: Synthetic oligonucleotide
aaucccaucccucguccuucagg

SEQ ID NO: 1572 - RNA, 23 nt, Artificial Sequence
  Description of Artificial Sequence: Synthetic oligonucleotide
aaaucccaucccucguccuucag

SEQ ID NO: 1573 - RNA, 23 nt, Artificial Sequence
  Description of Artificial Sequence: Synthetic oligonucleotide
aaaucccaucccucguccuucag

SEQ ID NO: 1574 - RNA, 23 nt, Artificial Sequence
  Description of Artificial Sequence: Synthetic oligonucleotide
gaaaucccaucccucguccuuca

SEQ ID NO: 1575 - RNA, 23 nt, Artificial Sequence
  Description of Artificial Sequence: Synthetic oligonucleotide
gaaaucccaucccucguccuuca

SEQ ID NO: 1576 - RNA, 23 nt, Artificial Sequence
  Description of Artificial Sequence: Synthetic oligonucleotide
ugaaaucccaucccucguccuuc

SEQ ID NO: 1577 - RNA, 23 nt, Artificial Sequence
  Description of Artificial Sequence: Synthetic oligonucleotide
ugaaaucccaucccucguccuuc

SEQ ID NO: 1578 - RNA, 23 nt, Artificial Sequence
  Description of Artificial Sequence: Synthetic oligonucleotide
augaaaucccaucccucguccuu

SEQ ID NO: 1579 - RNA, 23 nt, Artificial Sequence
  Description of Artificial Sequence: Synthetic oligonucleotide
augaaaucccaucccucguccuu

SEQ ID NO: 1580 - RNA, 23 nt, Artificial Sequence
  Description of Artificial Sequence: Synthetic oligonucleotide
caugaaaucccaucccucguccu

SEQ ID NO: 1581 - RNA, 23 nt, Artificial Sequence
  Description of Artificial Sequence: Synthetic oligonucleotide
caugaaaucccaucccucguccu

SEQ ID NO: 1582 - RNA, 23 nt, Artificial Sequence
  Description of Artificial Sequence: Synthetic oligonucleotide
acaugaaaucccaucccucgucc

SEQ ID NO: 1583 - RNA, 23 nt, Artificial Sequence
  Description of Artificial Sequence: Synthetic oligonucleotide
acaugaaaucccaucccucgucc

SEQ ID NO: 1584 - RNA, 23 nt, Artificial Sequence
  Description of Artificial Sequence: Synthetic oligonucleotide
uacaugaaaucccaucccucguc

SEQ ID NO: 1585 - RNA, 23 nt, Artificial Sequence
  Description of Artificial Sequence: Synthetic oligonucleotide
uacaugaaaucccaucccucguc

SEQ ID NO: 1586 - RNA, 23 nt, Artificial Sequence
  Description of Artificial Sequence: Synthetic oligonucleotide
uuacaugaaaucccaucccucgu

SEQ ID NO: 1587 - RNA, 23 nt, Artificial Sequence
  Description of Artificial Sequence: Synthetic oligonucleotide
uuacaugaaaucccaucccucgu

SEQ ID NO: 1588 - RNA, 23 nt, Artificial Sequence
  Description of Artificial Sequence: Synthetic oligonucleotide
guuacaugaaaucccaucccucg

SEQ ID NO: 1589 - RNA, 23 nt, Artificial Sequence
  Description of Artificial Sequence: Synthetic oligonucleotide
guuacaugaaaucccaucccucg

SEQ ID NO: 1590 - RNA, 23 nt, Artificial Sequence
  Description of Artificial Sequence: Synthetic oligonucleotide
gguuacaugaaaucccaucccuc

SEQ ID NO: 1591 - RNA, 23 nt, Artificial Sequence
  Description of Artificial Sequence: Synthetic oligonucleotide
gguuacaugaaaucccaucccuc

SEQ ID NO: 1592 - RNA, 23 nt, Artificial Sequence
  Description of Artificial Sequence: Synthetic oligonucleotide
ugguuacaugaaaucccaucccu

SEQ ID NO: 1593 - RNA, 23 nt, Artificial Sequence
  Description of Artificial Sequence: Synthetic oligonucleotide
ugguuacaugaaaucccaucccu

SEQ ID NO: 1594 - RNA, 23 nt, Artificial Sequence
  Description of Artificial Sequence: Synthetic oligonucleotide
uugguuacaugaaaucccauccc

SEQ ID NO: 1595 - RNA, 23 nt, Artificial Sequence
  Description of Artificial Sequence: Synthetic oligonucleotide
uugguuacaugaaaucccauccc

SEQ ID NO: 1596 - RNA, 23 nt, Artificial Sequence
  Description of Artificial Sequence: Synthetic oligonucleotide
cuugguuacaugaaaucccaucc

SEQ ID NO: 1597 - RNA, 23 nt, Artificial Sequence
  Description of Artificial Sequence: Synthetic oligonucleotide
cuugguuacaugaaaucccaucc

SEQ ID NO: 1598 - RNA, 23 nt, Artificial Sequence
  Description of Artificial Sequence: Synthetic oligonucleotide
ucuugguuacaugaaaucccauc

SEQ ID NO: 1599 - RNA, 23 nt, Artificial Sequence
  Description of Artificial Sequence: Synthetic oligonucleotide
ucuugguuacaugaaaucccauc

SEQ ID NO: 1600 - RNA, 23 nt, Artificial Sequence
  Description of Artificial Sequence: Synthetic oligonucleotide
cucuugguuacaugaaaucccau

SEQ ID NO: 1601 - RNA, 23 nt, Artificial Sequence
  Description of Artificial Sequence: Synthetic oligonucleotide
cucuugguuacaugaaaucccau

SEQ ID NO: 1602 - RNA, 23 nt, Artificial Sequence
  Description of Artificial Sequence: Synthetic oligonucleotide
acucuugguuacaugaaauccca

SEQ ID NO: 1603 - RNA, 23 nt, Artificial Sequence
  Description of Artificial Sequence: Synthetic oligonucleotide
acucuugguuacaugaaauccca

SEQ ID NO: 1604 - RNA, 23 nt, Artificial Sequence
  Description of Artificial Sequence: Synthetic oligonucleotide
uacucuugguuacaugaaauccc

SEQ ID NO: 1605 - RNA, 23 nt, Artificial Sequence
  Description of Artificial Sequence: Synthetic oligonucleotide
uacucuugguuacaugaaauccc

SEQ ID NO: 1606 - RNA, 23 nt, Artificial Sequence
  Description of Artificial Sequence: Synthetic oligonucleotide
auacucuugguuacaugaaaucc

SEQ ID NO: 1607 - RNA, 23 nt, Artificial Sequence
  Description of Artificial Sequence: Synthetic oligonucleotide
auacucuugguuacaugaaaucc

SEQ ID NO: 1608 - RNA, 23 nt, Artificial Sequence
  Description of Artificial Sequence: Synthetic oligonucleotide
aauacucuugguuacaugaaauc

SEQ ID NO: 1609 - RNA, 23 nt, Artificial Sequence
  Description of Artificial Sequence: Synthetic oligonucleotide
aauacucuugguuacaugaaauc

SEQ ID NO: 1610 - RNA, 23 nt, Artificial Sequence
  Description of Artificial Sequence: Synthetic oligonucleotide
gaauacucuugguuacaugaaau

SEQ ID NO: 1611 - RNA, 23 nt, Artificial Sequence
  Description of Artificial Sequence: Synthetic oligonucleotide
gaauacucuugguuacaugaaau

SEQ ID NO: 1612 - RNA, 23 nt, Artificial Sequence
  Description of Artificial Sequence: Synthetic oligonucleotide
ggaauacucuugguuacaugaaa

SEQ ID NO: 1613 - RNA, 23 nt, Artificial Sequence
  Description of Artificial Sequence: Synthetic oligonucleotide
ggaauacucuugguuacaugaaa

SEQ ID NO: 1614 - RNA, 23 nt, Artificial Sequence
  Description of Artificial Sequence: Synthetic oligonucleotide
uggaauacucuugguuacaugaa

SEQ ID NO: 1615 - RNA, 23 nt, Artificial Sequence
  Description of Artificial Sequence: Synthetic oligonucleotide
uggaauacucuugguuacaugaa

SEQ ID NO: 1616 - RNA, 23 nt, Artificial Sequence
  Description of Artificial Sequence: Synthetic oligonucleotide
auggaauacucuugguuacauga

SEQ ID NO: 1617 - RNA, 23 nt, Artificial Sequence
  Description of Artificial Sequence: Synthetic oligonucleotide
auggaauacucuugguuacauga

SEQ ID NO: 1618 - RNA, 23 nt, Artificial Sequence
  Description of Artificial Sequence: Synthetic oligonucleotide
aauggaauacucuugguuacaug

SEQ ID NO: 1619 - RNA, 23 nt, Artificial Sequence
  Description of Artificial Sequence: Synthetic oligonucleotide
aauggaauacucuugguuacaug

SEQ ID NO: 1620 - RNA, 23 nt, Artificial Sequence
  Description of Artificial Sequence: Synthetic oligonucleotide
aaauggaauacucuugguuacau

SEQ ID NO: 1621 - RNA, 23 nt, Artificial Sequence
  Description of Artificial Sequence: Synthetic oligonucleotide
aaauggaauacucuugguuacau

SEQ ID NO: 1622 - RNA, 23 nt, Artificial Sequence
  Description of Artificial Sequence: Synthetic oligonucleotide
aaaauggaauacucuugguuaca

SEQ ID NO: 1623 - RNA, 23 nt, Artificial Sequence
  Description of Artificial Sequence: Synthetic oligonucleotide
aaaauggaauacucuugguuaca

SEQ ID NO: 1624 - RNA, 23 nt, Artificial Sequence
  Description of Artificial Sequence: Synthetic oligonucleotide
aaaaauggaauacucuugguuac

SEQ ID NO: 1625 - RNA, 23 nt, Artificial Sequence
  Description of Artificial Sequence: Synthetic oligonucleotide
aaaaauggaauacucuugguuac

SEQ ID NO: 1626 - RNA, 23 nt, Artificial Sequence
  Description of Artificial Sequence: Synthetic oligonucleotide
uaaaaauggaauacucuugguua

SEQ ID NO: 1627 - RNA, 23 nt, Artificial Sequence
  Description of Artificial Sequence: Synthetic oligonucleotide
uaaaaauggaauacucuugguua

SEQ ID NO: 1628 - RNA, 23 nt, Artificial Sequence
  Description of Artificial Sequence: Synthetic oligonucleotide
guaaaaauggaauacucuugguu

SEQ ID NO: 1629 - RNA, 23 nt, Artificial Sequence
  Description of Artificial Sequence: Synthetic oligonucleotide
guaaaaauggaauacucuugguu

SEQ ID NO: 1630 - RNA, 23 nt, Artificial Sequence
  Description of Artificial Sequence: Synthetic oligonucleotide
aguaaaaauggaauacucuuggu

SEQ ID NO: 1631 - RNA, 23 nt, Artificial Sequence
  Description of Artificial Sequence: Synthetic oligonucleotide
aguaaaaauggaauacucuuggu

SEQ ID NO: 1632 - RNA, 23 nt, Artificial Sequence
  Description of Artificial Sequence: Synthetic oligonucleotide
uaguaaaaauggaauacucuugg

SEQ ID NO: 1633 - RNA, 23 nt, Artificial Sequence
  Description of Artificial Sequence: Synthetic oligonucleotide
uaguaaaaauggaauacucuugg

SEQ ID NO: 1634 - RNA, 23 nt, Artificial Sequence
  Description of Artificial Sequence: Synthetic oligonucleotide
uuaguaaaaauggaauacucuug

SEQ ID NO: 1635 - RNA, 23 nt, Artificial Sequence
  Description of Artificial Sequence: Synthetic oligonucleotide
uuaguaaaaauggaauacucuug

SEQ ID NO: 1636 - RNA, 23 nt, Artificial Sequence
  Description of Artificial Sequence: Synthetic oligonucleotide
uuuaguaaaaauggaauacucuu

SEQ ID NO: 1637 - RNA, 23 nt, Artificial Sequence
  Description of Artificial Sequence: Synthetic oligonucleotide
uuuaguaaaaauggaauacucuu

SEQ ID NO: 1638 - RNA, 23 nt, Artificial Sequence
  Description of Artificial Sequence: Synthetic oligonucleotide
cuuuaguaaaaauggaauacucu

SEQ ID NO: 1639 - RNA, 23 nt, Artificial Sequence
  Description of Artificial Sequence: Synthetic oligonucleotide
cuuuaguaaaaauggaauacucu

SEQ ID NO: 1640 - RNA, 23 nt, Artificial Sequence
  Description of Artificial Sequence: Synthetic oligonucleotide
gcuuuaguaaaaauggaauacuc

SEQ ID NO: 1641 - RNA, 23 nt, Artificial Sequence
  Description of Artificial Sequence: Synthetic oligonucleotide
gcuuuaguaaaaauggaauacuc

SEQ ID NO: 1642 - RNA, 23 nt, Artificial Sequence
  Description of Artificial Sequence: Synthetic oligonucleotide
ugcuuuaguaaaaauggaauacu

SEQ ID NO: 1643 - RNA, 23 nt, Artificial Sequence
  Description of Artificial Sequence: Synthetic oligonucleotide
ugcuuuaguaaaaauggaauacu

SEQ ID NO: 1644 - RNA, 23 nt, Artificial Sequence
  Description of Artificial Sequence: Synthetic oligonucleotide
cugcuuuaguaaaaauggaauac

SEQ ID NO: 1645 - RNA, 23 nt, Artificial Sequence
  Description of Artificial Sequence: Synthetic oligonucleotide
cugcuuuaguaaaaauggaauac

SEQ ID NO: 1646 - RNA, 23 nt, Artificial Sequence
  Description of Artificial Sequence: Synthetic oligonucleotide
acugcuuuaguaaaaauggaaua

SEQ ID NO: 1647 - RNA, 23 nt, Artificial Sequence
  Description of Artificial Sequence: Synthetic oligonucleotide
acugcuuuaguaaaaauggaaua

SEQ ID NO: 1648 - RNA, 23 nt, Artificial Sequence
  Description of Artificial Sequence: Synthetic oligonucleotide
cacugcuuuaguaaaaauggaau

SEQ ID NO: 1649 - RNA, 23 nt, Artificial Sequence
  Description of Artificial Sequence: Synthetic oligonucleotide
cacugcuuuaguaaaaauggaau

SEQ ID NO: 1650 - RNA, 23 nt, Artificial Sequence
  Description of Artificial Sequence: Synthetic oligonucleotide
acacugcuuuaguaaaaauggaa

SEQ ID NO: 1651 - RNA, 23 nt, Artificial Sequence
  Description of Artificial Sequence: Synthetic oligonucleotide
acacugcuuuaguaaaaauggaa

SEQ ID NO: 1652 - RNA, 23 nt, Artificial Sequence
  Description of Artificial Sequence: Synthetic oligonucleotide
aacacugcuuuaguaaaaaugga

SEQ ID NO: 1653 - RNA, 23 nt, Artificial Sequence
  Description of Artificial Sequence: Synthetic oligonucleotide
aacacugcuuuaguaaaaaugga

SEQ ID NO: 1654 - RNA, 23 nt, Artificial Sequence
  Description of Artificial Sequence: Synthetic oligonucleotide
aaacacugcuuuaguaaaaaugg

SEQ ID NO: 1655 - RNA, 23 nt, Artificial Sequence
  Description of Artificial Sequence: Synthetic oligonucleotide
aaacacugcuuuaguaaaaaugg

SEQ ID NO: 1656 - RNA, 23 nt, Artificial Sequence
  Description of Artificial Sequence: Synthetic oligonucleotide
aaaacacugcuuuaguaaaaaug

SEQ ID NO: 1657 - RNA, 23 nt, Artificial Sequence
  Description of Artificial Sequence: Synthetic oligonucleotide
aaaacacugcuuuaguaaaaaug

SEQ ID NO: 1658 - RNA, 23 nt, Artificial Sequence
  Description of Artificial Sequence: Synthetic oligonucleotide
gaaaacacugcuuuaguaaaaau

SEQ ID NO: 1659 - RNA, 23 nt, Artificial Sequence
  Description of Artificial Sequence: Synthetic oligonucleotide
gaaaacacugcuuuaguaaaaau

SEQ ID NO: 1660 - RNA, 23 nt, Artificial Sequence
  Description of Artificial Sequence: Synthetic oligonucleotide
ugaaaacacugcuuuaguaaaaa

SEQ ID NO: 1661 - RNA, 23 nt, Artificial Sequence
  Description of Artificial Sequence: Synthetic oligonucleotide
ugaaaacacugcuuuaguaaaaa

SEQ ID NO: 1662 - RNA, 23 nt, Artificial Sequence
  Description of Artificial Sequence: Synthetic oligonucleotide
gugaaaacacugcuuuaguaaaa

SEQ ID NO: 1663 - RNA, 23 nt, Artificial Sequence
  Description of Artificial Sequence: Synthetic oligonucleotide
gugaaaacacugcuuuaguaaaa

SEQ ID NO: 1664 - RNA, 23 nt, Artificial Sequence
  Description of Artificial Sequence: Synthetic oligonucleotide
ggugaaaacacugcuuuaguaaa

SEQ ID NO: 1665 - RNA, 23 nt, Artificial Sequence
  Description of Artificial Sequence: Synthetic oligonucleotide
ggugaaaacacugcuuuaguaaa

SEQ ID NO: 1666 - RNA, 23 nt, Artificial Sequence
  Description of Artificial Sequence: Synthetic oligonucleotide
aggugaaaacacugcuuuaguaa

SEQ ID NO: 1667 - RNA, 23 nt, Artificial Sequence
  Description of Artificial Sequence: Synthetic oligonucleotide
aggugaaaacacugcuuuaguaa

SEQ ID NO: 1668 - RNA, 23 nt, Artificial Sequence
  Description of Artificial Sequence: Synthetic oligonucleotide
gaggugaaaacacugcuuuagua

SEQ ID NO: 1669 - RNA, 23 nt, Artificial Sequence
  Description of Artificial Sequence: Synthetic oligonucleotide
gaggugaaaacacugcuuuagua

SEQ ID NO: 1670 - RNA, 23 nt, Artificial Sequence
  Description of Artificial Sequence: Synthetic oligonucleotide
ugaggugaaaacacugcuuuagu

SEQ ID NO: 1671 - RNA, 23 nt, Artificial Sequence
  Description of Artificial Sequence: Synthetic oligonucleotide
ugaggugaaaacacugcuuuagu

SEQ ID NO: 1672 - RNA, 23 nt, Artificial Sequence
  Description of Artificial Sequence: Synthetic oligonucleotide
augaggugaaaacacugcuuuag

SEQ ID NO: 1673 - RNA, 23 nt, Artificial Sequence
  Description of Artificial Sequence: Synthetic oligonucleotide
augaggugaaaacacugcuuuag

SEQ ID NO: 1674 - RNA, 23 nt, Artificial Sequence
  Description of Artificial Sequence: Synthetic oligonucleotide
uaugaggugaaaacacugcuuua

SEQ ID NO: 1675 - RNA, 23 nt, Artificial Sequence
  Description of Artificial Sequence: Synthetic oligonucleotide
uaugaggugaaaacacugcuuua

SEQ ID NO: 1676 - RNA, 23 nt, Artificial Sequence
  Description of Artificial Sequence: Synthetic oligonucleotide
auaugaggugaaaacacugcuuu

SEQ ID NO: 1677 - RNA, 23 nt, Artificial Sequence
  Description of Artificial Sequence: Synthetic oligonucleotide
auaugaggugaaaacacugcuuu

SEQ ID NO: 1678 - RNA, 23 nt, Artificial Sequence
  Description of Artificial Sequence: Synthetic oligonucleotide
cauaugaggugaaaacacugcuu

SEQ ID NO: 1679 - RNA, 23 nt, Artificial Sequence
  Description of Artificial Sequence: Synthetic oligonucleotide
cauaugaggugaaaacacugcuu

SEQ ID NO: 1680 - RNA, 23 nt, Artificial Sequence
  Description of Artificial Sequence: Synthetic oligonucleotide
gcauaugaggugaaaacacugcu

SEQ ID NO: 1681 - RNA, 23 nt, Artificial Sequence
  Description of Artificial Sequence: Synthetic oligonucleotide
gcauaugaggugaaaacacugcu

SEQ ID NO: 1682 - RNA, 23 nt, Artificial Sequence
  Description of Artificial Sequence: Synthetic oligonucleotide
agcauaugaggugaaaacacugc

SEQ ID NO: 1683 - RNA, 23 nt, Artificial Sequence
  Description of Artificial Sequence: Synthetic oligonucleotide
agcauaugaggugaaaacacugc

SEQ ID NO: 1684 - RNA, 23 nt, Artificial Sequence
  Description of Artificial Sequence: Synthetic oligonucleotide
uagcauaugaggugaaaacacug

SEQ ID NO: 1685 - RNA, 23 nt, Artificial Sequence
  Description of Artificial Sequence: Synthetic oligonucleotide
uagcauaugaggugaaaacacug

SEQ ID NO: 1686 - RNA, 23 nt, Artificial Sequence
  Description of Artificial Sequence: Synthetic oligonucleotide
auagcauaugaggugaaaacacu

SEQ ID NO: 1687 - RNA, 23 nt, Artificial Sequence
  Description of Artificial Sequence: Synthetic oligonucleotide
auagcauaugaggugaaaacacu

SEQ ID NO: 1688 - RNA, 23 nt, Artificial Sequence
  Description of Artificial Sequence: Synthetic oligonucleotide
cauagcauaugaggugaaaacac

SEQ ID NO: 1689 - RNA, 23 nt, Artificial Sequence
  Description of Artificial Sequence: Synthetic oligonucleotide
cauagcauaugaggugaaaacac

SEQ ID NO: 1690 - RNA, 23 nt, Artificial Sequence
  Description of Artificial Sequence: Synthetic oligonucleotide
acauagcauaugaggugaaaaca

SEQ ID NO: 1691 - RNA, 23 nt, Artificial Sequence
  Description of Artificial Sequence: Synthetic oligonucleotide
acauagcauaugaggugaaaaca

SEQ ID NO: 1692 - RNA, 23 nt, Artificial Sequence
  Description of Artificial Sequence: Synthetic oligonucleotide
aacauagcauaugaggugaaaac

SEQ ID NO: 1693 - RNA, 23 nt, Artificial Sequence
  Description of Artificial Sequence: Synthetic oligonucleotide
aacauagcauaugaggugaaaac

SEQ ID NO: 1694 - RNA, 23 nt, Artificial Sequence
  Description of Artificial Sequence: Synthetic oligonucleotide
uaacauagcauaugaggugaaaa

SEQ ID NO: 1695 - RNA, 23 nt, Artificial Sequence
  Description of Artificial Sequence: Synthetic oligonucleotide
uaacauagcauaugaggugaaaa

SEQ ID NO: 1696 - RNA, 23 nt, Artificial Sequence
  Description of Artificial Sequence: Synthetic oligonucleotide
cuaacauagcauaugaggugaaa

SEQ ID NO: 1697 - RNA, 23 nt, Artificial Sequence
  Description of Artificial Sequence: Synthetic oligonucleotide
cuaacauagcauaugaggugaaa

SEQ ID NO: 1698 - RNA, 23 nt, Artificial Sequence
  Description of Artificial Sequence: Synthetic oligonucleotide
ucuaacauagcauaugaggugaa

SEQ ID NO: 1699 - RNA, 23 nt, Artificial Sequence
  Description of Artificial Sequence: Synthetic oligonucleotide
ucuaacauagcauaugaggugaa

SEQ ID NO: 1700 - RNA, 23 nt, Artificial Sequence
  Description of Artificial Sequence: Synthetic oligonucleotide
uucuaacauagcauaugagguga

SEQ ID NO: 1701 - RNA, 23 nt, Artificial Sequence
  Description of Artificial Sequence: Synthetic oligonucleotide
uucuaacauagcauaugagguga

SEQ ID NO: 1702 - RNA, 23 nt, Artificial Sequence
  Description of Artificial Sequence: Synthetic oligonucleotide
cuucuaacauagcauaugaggug

SEQ ID NO: 1703 - RNA, 23 nt, Artificial Sequence
  Description of Artificial Sequence: Synthetic oligonucleotide
cuucuaacauagcauaugaggug

SEQ ID NO: 1704 - RNA, 23 nt, Artificial Sequence
  Description of Artificial Sequence: Synthetic oligonucleotide
acuucuaacauagcauaugaggu

SEQ ID NO: 1705 - RNA, 23 nt, Artificial Sequence
  Description of Artificial Sequence: Synthetic oligonucleotide
acuucuaacauagcauaugaggu

SEQ ID NO: 1706 - RNA, 23 nt, Artificial Sequence
  Description of Artificial Sequence: Synthetic oligonucleotide
gacuucuaacauagcauaugagg

SEQ ID NO: 1707 - RNA, 23 nt, Artificial Sequence
  Description of Artificial Sequence: Synthetic oligonucleotide
gacuucuaacauagcauaugagg

SEQ ID NO: 1708 - RNA, 23 nt, Artificial Sequence
  Description of Artificial Sequence: Synthetic oligonucleotide
ggacuucuaacauagcauaugag

SEQ ID NO: 1709 - RNA, 23 nt, Artificial Sequence
  Description of Artificial Sequence: Synthetic oligonucleotide
ggacuucuaacauagcauaugag

SEQ ID NO: 1710 - RNA, 23 nt, Artificial Sequence
  Description of Artificial Sequence: Synthetic oligonucleotide
uggacuucuaacauagcauauga

SEQ ID NO: 1711 - RNA, 23 nt, Artificial Sequence
  Description of Artificial Sequence: Synthetic oligonucleotide
uggacuucuaacauagcauauga

SEQ ID NO: 1712 - RNA, 23 nt, Artificial Sequence
  Description of Artificial Sequence: Synthetic oligonucleotide
cuggacuucuaacauagcauaug

SEQ ID NO: 1713 - RNA, 23 nt, Artificial Sequence
  Description of Artificial Sequence: Synthetic oligonucleotide
cuggacuucuaacauagcauaug

SEQ ID NO: 1714 - RNA, 23 nt, Artificial Sequence
  Description of Artificial Sequence: Synthetic oligonucleotide
ccuggacuucuaacauagcauau

SEQ ID NO: 1715 - RNA, 23 nt, Artificial Sequence
  Description of Artificial Sequence: Synthetic oligonucleotide
ccuggacuucuaacauagcauau

SEQ ID NO: 1716 - RNA, 23 nt, Artificial Sequence
  Description of Artificial Sequence: Synthetic oligonucleotide
gccuggacuucuaacauagcaua

SEQ ID NO: 1717 - RNA, 23 nt, Artificial Sequence
  Description of Artificial Sequence: Synthetic oligonucleotide
gccuggacuucuaacauagcaua

SEQ ID NO: 1718 - RNA, 23 nt, Artificial Sequence
  Description of Artificial Sequence: Synthetic oligonucleotide
ugccuggacuucuaacauagcau

SEQ ID NO: 1719 - RNA, 23 nt, Artificial Sequence
  Description of Artificial Sequence: Synthetic oligonucleotide
ugccuggacuucuaacauagcau

SEQ ID NO: 1720 - RNA, 23 nt, Artificial Sequence
  Description of Artificial Sequence: Synthetic oligonucleotide
cugccuggacuucuaacauagca

SEQ ID NO: 1721 - RNA, 23 nt, Artificial Sequence
  Description of Artificial Sequence: Synthetic oligonucleotide
cugccuggacuucuaacauagca

SEQ ID NO: 1722 - RNA, 23 nt, Artificial Sequence
  Description of Artificial Sequence: Synthetic oligonucleotide
ucugccuggacuucuaacauagc

SEQ ID NO: 1723 - RNA, 23 nt, Artificial Sequence
  Description of Artificial Sequence: Synthetic oligonucleotide
ucugccuggacuucuaacauagc

SEQ ID NO: 1724 - RNA, 23 nt, Artificial Sequence
  Description of Artificial Sequence: Synthetic oligonucleotide
cucugccuggacuucuaacauag

SEQ ID NO: 1725 - RNA, 23 nt, Artificial Sequence
  Description of Artificial Sequence: Synthetic oligonucleotide
cucugccuggacuucuaacauag

SEQ ID NO: 1726 - RNA, 23 nt, Artificial Sequence
  Description of Artificial Sequence: Synthetic oligonucleotide
ucucugccuggacuucuaacaua

SEQ ID NO: 1727 - RNA, 23 nt, Artificial Sequence
  Description of Artificial Sequence: Synthetic oligonucleotide
ucucugccuggacuucuaacaua

SEQ ID NO: 1728 - RNA, 23 nt, Artificial Sequence
  Description of Artificial Sequence: Synthetic oligonucleotide
gucucugccuggacuucuaacau

SEQ ID NO: 1729 - RNA, 23 nt, Artificial Sequence
  Description of Artificial Sequence: Synthetic oligonucleotide
gucucugccuggacuucuaacau

SEQ ID NO: 1730 - RNA, 23 nt, Artificial Sequence
  Description of Artificial Sequence: Synthetic oligonucleotide
ugucucugccuggacuucuaaca

SEQ ID NO: 1731 - RNA, 23 nt, Artificial Sequence
  Description of Artificial Sequence: Synthetic oligonucleotide
ugucucugccuggacuucuaaca

SEQ ID NO: 1732 - RNA, 23 nt, Artificial Sequence
  Description of Artificial Sequence: Synthetic oligonucleotide
uugucucugccuggacuucuaac

SEQ ID NO: 1733 - RNA, 23 nt, Artificial Sequence
  Description of Artificial Sequence: Synthetic oligonucleotide
uugucucugccuggacuucuaac

SEQ ID NO: 1734 - RNA, 23 nt, Artificial Sequence
  Description of Artificial Sequence: Synthetic oligonucleotide
auugucucugccuggacuucuaa

SEQ ID NO: 1735 - RNA, 23 nt, Artificial Sequence
  Description of Artificial Sequence: Synthetic oligonucleotide
auugucucugccuggacuucuaa

SEQ ID NO: 1736 - RNA, 23 nt, Artificial Sequence
  Description of Artificial Sequence: Synthetic oligonucleotide
uauugucucugccuggacuucua

SEQ ID NO: 1737 - RNA, 23 nt, Artificial Sequence
  Description of Artificial Sequence: Synthetic oligonucleotide
uauugucucugccuggacuucua

SEQ ID NO: 1738 - RNA, 23 nt, Artificial Sequence
  Description of Artificial Sequence: Synthetic oligonucleotide
uuauugucucugccuggacuucu

SEQ ID NO: 1739 - RNA, 23 nt, Artificial Sequence
  Description of Artificial Sequence: Synthetic oligonucleotide
uuauugucucugccuggacuucu

SEQ ID NO: 1740 - RNA, 23 nt, Artificial Sequence
  Description of Artificial Sequence: Synthetic oligonucleotide
uuuauugucucugccuggacuuc

SEQ ID NO: 1741 - RNA, 23 nt, Artificial Sequence
  Description of Artificial Sequence: Synthetic oligonucleotide
uuuauugucucugccuggacuuc

SEQ ID NO: 1742 - RNA, 23 nt, Artificial Sequence
  Description of Artificial Sequence: Synthetic oligonucleotide
uuuuauugucucugccuggacuu

SEQ ID NO: 1743 - RNA, 23 nt, Artificial Sequence
  Description of Artificial Sequence: Synthetic oligonucleotide
uuuuauugucucugccuggacuu

SEQ ID NO: 1744 - RNA, 23 nt, Artificial Sequence
  Description of Artificial Sequence: Synthetic oligonucleotide
guuuuauugucucugccuggacu

SEQ ID NO: 1745 - RNA, 23 nt, Artificial Sequence
  Description of Artificial Sequence: Synthetic oligonucleotide
guuuuauugucucugccuggacu

SEQ ID NO: 1746 - RNA, 23 nt, Artificial Sequence
  Description of Artificial Sequence: Synthetic oligonucleotide
uguuuuauugucucugccuggac

SEQ ID NO: 1747 - RNA, 23 nt, Artificial Sequence
  Description of Artificial Sequence: Synthetic oligonucleotide
uguuuuauugucucugccuggac

SEQ ID NO: 1748 - RNA, 23 nt, Artificial Sequence
  Description of Artificial Sequence: Synthetic oligonucleotide
auguuuuauugucucugccugga

SEQ ID NO: 1749 - RNA, 23 nt, Artificial Sequence
  Description of Artificial Sequence: Synthetic oligonucleotide
auguuuuauugucucugccugga

SEQ ID NO: 1750 - RNA, 23 nt, Artificial Sequence
  Description of Artificial Sequence: Synthetic oligonucleotide
aauguuuuauugucucugccugg

SEQ ID NO: 1751 - RNA, 23 nt, Artificial Sequence
  Description of Artificial Sequence: Synthetic oligonucleotide
aauguuuuauugucucugccugg

SEQ ID NO: 1752 - RNA, 23 nt, Artificial Sequence
  Description of Artificial Sequence: Synthetic oligonucleotide
gaauguuuuauugucucugccug

SEQ ID NO: 1753 - RNA, 23 nt, Artificial Sequence
  Description of Artificial Sequence: Synthetic oligonucleotide
gaauguuuuauugucucugccug

SEQ ID NO: 1754 - RNA, 23 nt, Artificial Sequence
  Description of Artificial Sequence: Synthetic oligonucleotide
ggaauguuuuauugucucugccu

SEQ ID NO: 1755 - RNA, 23 nt, Artificial Sequence
  Description of Artificial Sequence: Synthetic oligonucleotide
ggaauguuuuauugucucugccu

SEQ ID NO: 1756 - RNA, 23 nt, Artificial Sequence
  Description of Artificial Sequence: Synthetic oligonucleotide
aggaauguuuuauugucucugcc

SEQ ID NO: 1757 - RNA, 23 nt, Artificial Sequence
  Description of Artificial Sequence: Synthetic oligonucleotide
aggaauguuuuauugucucugcc

SEQ ID NO: 1758 - RNA, 23 nt, Artificial Sequence
  Description of Artificial Sequence: Synthetic oligonucleotide
caggaauguuuuauugucucugc

SEQ ID NO: 1759 - RNA, 23 nt, Artificial Sequence
  Description of Artificial Sequence: Synthetic oligonucleotide
caggaauguuuuauugucucugc

SEQ ID NO: 1760 - RNA, 23 nt, Artificial Sequence
  Description of Artificial Sequence: Synthetic oligonucleotide
acaggaauguuuuauugucucug

SEQ ID NO: 1761 - RNA, 23 nt, Artificial Sequence
  Description of Artificial Sequence: Synthetic oligonucleotide
acaggaauguuuuauugucucug

SEQ ID NO: 1762 - RNA, 23 nt, Artificial Sequence
  Description of Artificial Sequence: Synthetic oligonucleotide
cacaggaauguuuuauugucucu

SEQ ID NO: 1763 - RNA, 23 nt, Artificial Sequence
  Description of Artificial Sequence: Synthetic oligonucleotide
cacaggaauguuuuauugucucu

SEQ ID NO: 1764 - RNA, 23 nt, Artificial Sequence
  Description of Artificial Sequence: Synthetic oligonucleotide
ucacaggaauguuuuauugucuc

SEQ ID NO: 1765 - RNA, 23 nt, Artificial Sequence
  Description of Artificial Sequence: Synthetic oligonucleotide
ucacaggaauguuuuauugucuc

SEQ ID NO: 1766 - RNA, 23 nt, Artificial Sequence
  Description of Artificial Sequence: Synthetic oligonucleotide
uucacaggaauguuuuauugucu

SEQ ID NO: 1767 - RNA, 23 nt, Artificial Sequence
  Description of Artificial Sequence: Synthetic oligonucleotide
uucacaggaauguuuuauugucu

SEQ ID NO: 1768 - RNA, 23 nt, Artificial Sequence
  Description of Artificial Sequence: Synthetic oligonucleotide
uuucacaggaauguuuuauuguc

SEQ ID NO: 1769 - RNA, 23 nt, Artificial Sequence
  Description of Artificial Sequence: Synthetic oligonucleotide
uuucacaggaauguuuuauuguc

SEQ ID NO: 1770 - RNA, 23 nt, Artificial Sequence
  Description of Artificial Sequence: Synthetic oligonucleotide
cuuucacaggaauguuuuauugu

SEQ ID NO: 1771 - RNA, 23 nt, Artificial Sequence
  Description of Artificial Sequence: Synthetic oligonucleotide
cuuucacaggaauguuuuauugu

SEQ ID NO: 1772 - RNA, 23 nt, Artificial Sequence
  Description of Artificial Sequence: Synthetic oligonucleotide
ccuuucacaggaauguuuuauug

SEQ ID NO: 1773 - RNA, 23 nt, Artificial Sequence
  Description of Artificial Sequence: Synthetic oligonucleotide
ccuuucacaggaauguuuuauug

SEQ ID NO: 1774 - RNA, 23 nt, Artificial Sequence
  Description of Artificial Sequence: Synthetic oligonucleotide
gccuuucacaggaauguuuuauu

SEQ ID NO: 1775 - RNA, 23 nt, Artificial Sequence
  Description of Artificial Sequence: Synthetic oligonucleotide
gccuuucacaggaauguuuuauu

SEQ ID NO: 1776 - RNA, 23 nt, Artificial Sequence
  Description of Artificial Sequence: Synthetic oligonucleotide
ugccuuucacaggaauguuuuau

SEQ ID NO: 1777 - RNA, 23 nt, Artificial Sequence
  Description of Artificial Sequence: Synthetic oligonucleotide
ugccuuucacaggaauguuuuau

SEQ ID NO: 1778 - RNA, 23 nt, Artificial Sequence
  Description of Artificial Sequence: Synthetic oligonucleotide
gugccuuucacaggaauguuuua

SEQ ID NO: 1779 - RNA, 23 nt, Artificial Sequence
  Description of Artificial Sequence: Synthetic oligonucleotide
gugccuuucacaggaauguuuua

SEQ ID NO: 1780 - RNA, 23 nt, Artificial Sequence
  Description of Artificial Sequence: Synthetic oligonucleotide
agugccuuucacaggaauguuuu

SEQ ID NO: 1781 - RNA, 23 nt, Artificial Sequence
  Description of Artificial Sequence: Synthetic oligonucleotide
agugccuuucacaggaauguuuu

SEQ ID NO: 1782 - RNA, 23 nt, Artificial Sequence
  Description of Artificial Sequence: Synthetic oligonucleotide
aagugccuuucacaggaauguuu

SEQ ID NO: 1783 - RNA, 23 nt, Artificial Sequence
  Description of Artificial Sequence: Synthetic oligonucleotide
aagugccuuucacaggaauguuu

SEQ ID NO: 1784 - RNA, 23 nt, Artificial Sequence
  Description of Artificial Sequence: Synthetic oligonucleotide
aaagugccuuucacaggaauguu

SEQ ID NO: 1785 - RNA, 23 nt, Artificial Sequence
  Description of Artificial Sequence: Synthetic oligonucleotide
aaagugccuuucacaggaauguu

SEQ ID NO: 1786 - RNA, 23 nt, Artificial Sequence
  Description of Artificial Sequence: Synthetic oligonucleotide
aaaagugccuuucacaggaaugu

SEQ ID NO: 1787 - RNA, 23 nt, Artificial Sequence
  Description of Artificial Sequence: Synthetic oligonucleotide
aaaagugccuuucacaggaaugu

SEQ ID NO: 1788 - RNA, 23 nt, Artificial Sequence
  Description of Artificial Sequence: Synthetic oligonucleotide
gaaaagugccuuucacaggaaug

SEQ ID NO: 1789 - RNA, 23 nt, Artificial Sequence
  Description of Artificial Sequence: Synthetic oligonucleotide
gaaaagugccuuucacaggaaug

SEQ ID NO: 1790 - RNA, 23 nt, Artificial Sequence
  Description of Artificial Sequence: Synthetic oligonucleotide
ugaaaagugccuuucacaggaau

SEQ ID NO: 1791 - RNA, 23 nt, Artificial Sequence
  Description of Artificial Sequence: Synthetic oligonucleotide
ugaaaagugccuuucacaggaau

SEQ ID NO: 1792 - RNA, 23 nt, Artificial Sequence
  Description of Artificial Sequence: Synthetic oligonucleotide
augaaaagugccuuucacaggaa

SEQ ID NO: 1793 - RNA, 23 nt, Artificial Sequence
  Description of Artificial Sequence: Synthetic oligonucleotide
augaaaagugccuuucacaggaa

SEQ ID NO: 1794 - RNA, 23 nt, Artificial Sequence
  Description of Artificial Sequence: Synthetic oligonucleotide
aaugaaaagugccuuucacagga

SEQ ID NO: 1795 - RNA, 23 nt, Artificial Sequence
  Description of Artificial Sequence: Synthetic oligonucleotide
aaugaaaagugccuuucacagga

SEQ ID NO: 1796 - RNA, 23 nt, Artificial Sequence
  Description of Artificial Sequence: Synthetic oligonucleotide
gaaugaaaagugccuuucacagg

SEQ ID NO: 1797 - RNA, 23 nt, Artificial Sequence
  Description of Artificial Sequence: Synthetic oligonucleotide
gaaugaaaagugccuuucacagg

SEQ ID NO: 1798 - RNA, 23 nt, Artificial Sequence
  Description of Artificial Sequence: Synthetic oligonucleotide
ggaaugaaaagugccuuucacag

SEQ ID NO: 1799 - RNA, 23 nt, Artificial Sequence
  Description of Artificial Sequence: Synthetic oligonucleotide
ggaaugaaaagugccuuucacag

SEQ ID NO: 1800 - RNA, 23 nt, Artificial Sequence
  Description of Artificial Sequence: Synthetic oligonucleotide
uggaaugaaaagugccuuucaca

SEQ ID NO: 1801 - RNA, 23 nt, Artificial Sequence
  Description of Artificial Sequence: Synthetic oligonucleotide
uggaaugaaaagugccuuucaca

SEQ ID NO: 1802 - RNA, 23 nt, Artificial Sequence
  Description of Artificial Sequence: Synthetic oligonucleotide
guggaaugaaaagugccuuucac

SEQ ID NO: 1803 - RNA, 23 nt, Artificial Sequence
  Description of Artificial Sequence: Synthetic oligonucleotide
guggaaugaaaagugccuuucac

SEQ ID NO: 1804 - RNA, 23 nt, Artificial Sequence
  Description of Artificial Sequence: Synthetic oligonucleotide
aguggaaugaaaagugccuuuca

SEQ ID NO: 1805 - RNA, 23 nt, Artificial Sequence
  Description of Artificial Sequence: Synthetic oligonucleotide
aguggaaugaaaagugccuuuca

SEQ ID NO: 1806 - RNA, 23 nt, Artificial Sequence
  Description of Artificial Sequence: Synthetic oligonucleotide
aaguggaaugaaaagugccuuuc

SEQ ID NO: 1807 - RNA, 23 nt, Artificial Sequence
  Description of Artificial Sequence: Synthetic oligonucleotide
aaguggaaugaaaagugccuuuc

SEQ ID NO: 1808 - RNA, 23 nt, Artificial Sequence
  Description of Artificial Sequence: Synthetic oligonucleotide
aaaguggaaugaaaagugccuuu

SEQ ID NO: 1809 - RNA, 23 nt, Artificial Sequence
  Description of Artificial Sequence: Synthetic oligonucleotide
aaaguggaaugaaaagugccuuu

SEQ ID NO: 1810 - RNA, 23 nt, Artificial Sequence
  Description of Artificial Sequence: Synthetic oligonucleotide
uaaaguggaaugaaaagugccuu

SEQ ID NO: 1811 - RNA, 23 nt, Artificial Sequence
  Description of Artificial Sequence: Synthetic oligonucleotide
uaaaguggaaugaaaagugccuu

SEQ ID NO: 1812 - RNA, 23 nt, Artificial Sequence
  Description of Artificial Sequence: Synthetic oligonucleotide
uuaaaguggaaugaaaagugccu

SEQ ID NO: 1813 - RNA, 23 nt, Artificial Sequence
  Description of Artificial Sequence: Synthetic oligonucleotide
uuaaaguggaaugaaaagugccu

SEQ ID NO: 1814 - RNA, 23 nt, Artificial Sequence
  Description of Artificial Sequence: Synthetic oligonucleotide
guuaaaguggaaugaaaagugcc

SEQ ID NO: 1815 - RNA, 23 nt, Artificial Sequence
  Description of Artificial Sequence: Synthetic oligonucleotide
guuaaaguggaaugaaaagugcc

SEQ ID NO: 1816 - RNA, 23 nt, Artificial Sequence
  Description of Artificial Sequence: Synthetic oligonucleotide
aguuaaaguggaaugaaaagugc

SEQ ID NO: 1817 - RNA, 23 nt, Artificial Sequence
  Description of Artificial Sequence: Synthetic oligonucleotide
aguuaaaguggaaugaaaagugc

SEQ ID NO: 1818 - RNA, 23 nt, Artificial Sequence
  Description of Artificial Sequence: Synthetic oligonucleotide
aaguuaaaguggaaugaaaagug

SEQ ID NO: 1819 - RNA, 23 nt, Artificial Sequence
  Description of Artificial Sequence: Synthetic oligonucleotide
aaguuaaaguggaaugaaaagug

SEQ ID NO: 1820 - RNA, 23 nt, Artificial Sequence
  Description of Artificial Sequence: Synthetic oligonucleotide
caaguuaaaguggaaugaaaagu

SEQ ID NO: 1821 - RNA, 23 nt, Artificial Sequence
  Description of Artificial Sequence: Synthetic oligonucleotide
caaguuaaaguggaaugaaaagu

SEQ ID NO: 1822 - RNA, 23 nt, Artificial Sequence
  Description of Artificial Sequence: Synthetic oligonucleotide
ucaaguuaaaguggaaugaaaag

SEQ ID NO: 1823 - RNA, 23 nt, Artificial Sequence
  Description of Artificial Sequence: Synthetic oligonucleotide
ucaaguuaaaguggaaugaaaag

SEQ ID NO: 1824 - RNA, 23 nt, Artificial Sequence
  Description of Artificial Sequence: Synthetic oligonucleotide
aucaaguuaaaguggaaugaaaa

SEQ ID NO: 1825 - RNA, 23 nt, Artificial Sequence
  Description of Artificial Sequence: Synthetic oligonucleotide
aucaaguuaaaguggaaugaaaa

SEQ ID NO: 1826 - RNA, 23 nt, Artificial Sequence
  Description of Artificial Sequence: Synthetic oligonucleotide
aaucaaguuaaaguggaaugaaa

SEQ ID NO: 1827 - RNA, 23 nt, Artificial Sequence
  Description of Artificial Sequence: Synthetic oligonucleotide
aaucaaguuaaaguggaaugaaa

SEQ ID NO: 1828 - RNA, 23 nt, Artificial Sequence
  Description of Artificial Sequence: Synthetic oligonucleotide
aaaucaaguuaaaguggaaugaa

SEQ ID NO: 1829 - RNA, 23 nt, Artificial Sequence
  Description of Artificial Sequence: Synthetic oligonucleotide
aaaucaaguuaaaguggaaugaa

SEQ ID NO: 1830 - RNA, 23 nt, Artificial Sequence
  Description of Artificial Sequence: Synthetic oligonucleotide
aaaaucaaguuaaaguggaauga

SEQ ID NO: 1831 - RNA, 23 nt, Artificial Sequence
  Description of Artificial Sequence: Synthetic oligonucleotide
aaaaucaaguuaaaguggaauga

SEQ ID NO: 1832 - RNA, 23 nt, Artificial Sequence
  Description of Artificial Sequence: Synthetic oligonucleotide
aaaaaucaaguuaaaguggaaug

SEQ ID NO: 1833 - RNA, 23 nt, Artificial Sequence
  Description of Artificial Sequence: Synthetic oligonucleotide
aaaaaucaaguuaaaguggaaug

SEQ ID NO: 1834 - RNA, 23 nt, Artificial Sequence
  Description of Artificial Sequence: Synthetic oligonucleotide
aaaaaaucaaguuaaaguggaau

SEQ ID NO: 1835 - RNA, 23 nt, Artificial Sequence
  Description of Artificial Sequence: Synthetic oligonucleotide
aaaaaaucaaguuaaaguggaau

SEQ ID NO: 1836 - RNA, 23 nt, Artificial Sequence
  Description of Artificial Sequence: Synthetic oligonucleotide
uaaaaaaucaaguuaaaguggaa

SEQ ID NO: 1837 - RNA, 23 nt, Artificial Sequence
  Description of Artificial Sequence: Synthetic oligonucleotide
uaaaaaaucaaguuaaaguggaa

SEQ ID NO: 1838 - RNA, 23 nt, Artificial Sequence
  Description of Artificial Sequence: Synthetic oligonucleotide
uuaaaaaaucaaguuaaagugga

SEQ ID NO: 1839 - RNA, 23 nt, Artificial Sequence
  Description of Artificial Sequence: Synthetic oligonucleotide
uuaaaaaaucaaguuaaagugga

SEQ ID NO: 1840 - RNA, 23 nt, Artificial Sequence
  Description of Artificial Sequence: Synthetic oligonucleotide
uuuaaaaaaucaaguuaaagugg

SEQ ID NO: 1841 - RNA, 23 nt, Artificial Sequence
  Description of Artificial Sequence: Synthetic oligonucleotide
uuuaaaaaaucaaguuaaagugg

SEQ ID NO: 1842 - RNA, 23 nt, Artificial Sequence
  Description of Artificial Sequence: Synthetic oligonucleotide
auuuaaaaaaucaaguuaaagug

SEQ ID NO: 1843 - RNA, 23 nt, Artificial Sequence
  Description of Artificial Sequence: Synthetic oligonucleotide
auuuaaaaaaucaaguuaaagug

SEQ ID NO: 1844 - RNA, 23 nt, Artificial Sequence
  Description of Artificial Sequence: Synthetic oligonucleotide
aauuuaaaaaaucaaguuaaagu

SEQ ID NO: 1845 - RNA, 23 nt, Artificial Sequence
  Description of Artificial Sequence: Synthetic oligonucleotide
aauuuaaaaaaucaaguuaaagu

SEQ ID NO: 1846 - RNA, 23 nt, Artificial Sequence
  Description of Artificial Sequence: Synthetic oligonucleotide
gaauuuaaaaaaucaaguuaaag

SEQ ID NO: 1847 - RNA, 23 nt, Artificial Sequence
  Description of Artificial Sequence: Synthetic oligonucleotide
gaauuuaaaaaaucaaguuaaag

SEQ ID NO: 1848 - RNA, 23 nt, Artificial Sequence
  Description of Artificial Sequence: Synthetic oligonucleotide
ggaauuuaaaaaaucaaguuaaa

SEQ ID NO: 1849 - RNA, 23 nt, Artificial Sequence
  Description of Artificial Sequence: Synthetic oligonucleotide
ggaauuuaaaaaaucaaguuaaa

SEQ ID NO: 1850 - RNA, 23 nt, Artificial Sequence
  Description of Artificial Sequence: Synthetic oligonucleotide
gggaauuuaaaaaaucaaguuaa

SEQ ID NO: 1851 - RNA, 23 nt, Artificial Sequence
  Description of Artificial Sequence: Synthetic oligonucleotide
gggaauuuaaaaaaucaaguuaa

SEQ ID NO: 1852 - RNA, 23 nt, Artificial Sequence
  Description of Artificial Sequence: Synthetic oligonucleotide
agggaauuuaaaaaaucaaguua

SEQ ID NO: 1853 - RNA, 23 nt, Artificial Sequence
  Description of Artificial Sequence: Synthetic oligonucleotide
agggaauuuaaaaaaucaaguua

SEQ ID NO: 1854 - RNA, 23 nt, Artificial Sequence
  Description of Artificial Sequence: Synthetic oligonucleotide
aagggaauuuaaaaaaucaaguu

SEQ ID NO: 1855 - RNA, 23 nt, Artificial Sequence
  Description of Artificial Sequence: Synthetic oligonucleotide
aagggaauuuaaaaaaucaaguu

SEQ ID NO: 1856 - RNA, 23 nt, Artificial Sequence
  Description of Artificial Sequence: Synthetic oligonucleotide
uaagggaauuuaaaaaaucaagu

SEQ ID NO: 1857 - RNA, 23 nt, Artificial Sequence
  Description of Artificial Sequence: Synthetic oligonucleotide
uaagggaauuuaaaaaaucaagu

SEQ ID NO: 1858 - RNA, 23 nt, Artificial Sequence
  Description of Artificial Sequence: Synthetic oligonucleotide
auaagggaauuuaaaaaaucaag

SEQ ID NO: 1859 - RNA, 23 nt, Artificial Sequence
  Description of Artificial Sequence: Synthetic oligonucleotide
auaagggaauuuaaaaaaucaag

SEQ ID NO: 1860 - RNA, 23 nt, Artificial Sequence
  Description of Artificial Sequence: Synthetic oligonucleotide
aauaagggaauuuaaaaaaucaa

SEQ ID NO: 1861 - RNA, 23 nt, Artificial Sequence
  Description of Artificial Sequence: Synthetic oligonucleotide
aauaagggaauuuaaaaaaucaa

SEQ ID NO: 1862 - RNA, 23 nt, Artificial Sequence
  Description of Artificial Sequence: Synthetic oligonucleotide
caauaagggaauuuaaaaaauca

SEQ ID NO: 1863 - RNA, 23 nt, Artificial Sequence
  Description of Artificial Sequence: Synthetic oligonucleotide
caauaagggaauuuaaaaaauca

SEQ ID NO: 1864 - RNA, 23 nt, Artificial Sequence
  Description of Artificial Sequence: Synthetic oligonucleotide
acaauaagggaauuuaaaaaauc

SEQ ID NO: 1865 - RNA, 23 nt, Artificial Sequence
  Description of Artificial Sequence: Synthetic oligonucleotide
acaauaagggaauuuaaaaaauc

SEQ ID NO: 1866 - RNA, 23 nt, Artificial Sequence
  Description of Artificial Sequence: Synthetic oligonucleotide
gacaauaagggaauuuaaaaaau

SEQ ID NO: 1867 - RNA, 23 nt, Artificial Sequence
  Description of Artificial Sequence: Synthetic oligonucleotide
gacaauaagggaauuuaaaaaau

SEQ ID NO: 1868 - RNA, 23 nt, Artificial Sequence
  Description of Artificial Sequence: Synthetic oligonucleotide
ggacaauaagggaauuuaaaaaa

SEQ ID NO: 1869 - RNA, 23 nt, Artificial Sequence
  Description of Artificial Sequence: Synthetic oligonucleotide
ggacaauaagggaauuuaaaaaa

SEQ ID NO: 1870 - RNA, 23 nt, Artificial Sequence
  Description of Artificial Sequence: Synthetic oligonucleotide
gggacaauaagggaauuuaaaaa

SEQ ID NO: 1871 - RNA, 23 nt, Artificial Sequence
  Description of Artificial Sequence: Synthetic oligonucleotide
gggacaauaagggaauuuaaaaa

SEQ ID NO: 1872 - RNA, 23 nt, Artificial Sequence
  Description of Artificial Sequence: Synthetic oligonucleotide
agggacaauaagggaauuuaaaa

SEQ ID NO: 1873 - RNA, 23 nt, Artificial Sequence
  Description of Artificial Sequence: Synthetic oligonucleotide
agggacaauaagggaauuuaaaa

SEQ ID NO: 1874 - RNA, 23 nt, Artificial Sequence
  Description of Artificial Sequence: Synthetic oligonucleotide
aagggacaauaagggaauuuaaa

SEQ ID NO: 1875 - RNA, 23 nt, Artificial Sequence
  Description of Artificial Sequence: Synthetic oligonucleotide
aagggacaauaagggaauuuaaa

SEQ ID NO: 1876 - RNA, 23 nt, Artificial Sequence
  Description of Artificial Sequence: Synthetic oligonucleotide
gaagggacaauaagggaauuuaa

SEQ ID NO: 1877 - RNA, 23 nt, Artificial Sequence
  Description of Artificial Sequence: Synthetic oligonucleotide
gaagggacaauaagggaauuuaa

SEQ ID NO: 1878 - RNA, 23 nt, Artificial Sequence
  Description of Artificial Sequence: Synthetic oligonucleotide
ggaagggacaauaagggaauuua

SEQ ID NO: 1879 - RNA, 23 nt, Artificial Sequence
  Description of Artificial Sequence: Synthetic oligonucleotide
ggaagggacaauaagggaauuua

SEQ ID NO: 1880 - RNA, 23 nt, Artificial Sequence
  Description of Artificial Sequence: Synthetic oligonucleotide
uggaagggacaauaagggaauuu

SEQ ID NO: 1881 - RNA, 23 nt, Artificial Sequence
  Description of Artificial Sequence: Synthetic oligonucleotide
uggaagggacaauaagggaauuu

SEQ ID NO: 1882 - RNA, 23 nt, Artificial Sequence
  Description of Artificial Sequence: Synthetic oligonucleotide
uuggaagggacaauaagggaauu

SEQ ID NO: 1883 - RNA, 23 nt, Artificial Sequence
  Description of Artificial Sequence: Synthetic oligonucleotide
uuggaagggacaauaagggaauu

SEQ ID NO: 1884 - RNA, 23 nt, Artificial Sequence
  Description of Artificial Sequence: Synthetic oligonucleotide
uuuggaagggacaauaagggaau

SEQ ID NO: 1885 - RNA, 23 nt, Artificial Sequence
  Description of Artificial Sequence: Synthetic oligonucleotide
uuuggaagggacaauaagggaau

SEQ ID NO: 1886 - RNA, 23 nt, Artificial Sequence
  Description of Artificial Sequence: Synthetic oligonucleotide
uuuuggaagggacaauaagggaa

SEQ ID NO: 1887 - RNA, 23 nt, Artificial Sequence
  Description of Artificial Sequence: Synthetic oligonucleotide
uuuuggaagggacaauaagggaa

SEQ ID NO: 1888 - RNA, 23 nt, Artificial Sequence
  Description of Artificial Sequence: Synthetic oligonucleotide
uuuuuggaagggacaauaaggga

SEQ ID NO: 1889 - RNA, 23 nt, Artificial Sequence
  Description of Artificial Sequence: Synthetic oligonucleotide
uuuuuggaagggacaauaaggga

SEQ ID NO: 1890 - RNA, 23 nt, Artificial Sequence
  Description of Artificial Sequence: Synthetic oligonucleotide
uuuuuuggaagggacaauaaggg

SEQ ID NO: 1891 - RNA, 23 nt, Artificial Sequence
  Description of Artificial Sequence: Synthetic oligonucleotide
uuuuuuggaagggacaauaaggg

SEQ ID NO: 1892 - RNA, 23 nt, Artificial Sequence
  Description of Artificial Sequence: Synthetic oligonucleotide
uuuuuuuggaagggacaauaagg

SEQ ID NO: 1893 - RNA, 23 nt, Artificial Sequence
  Description of Artificial Sequence: Synthetic oligonucleotide
uuuuuuuggaagggacaauaagg

SEQ ID NO: 1894 - RNA, 23 nt, Artificial Sequence
  Description of Artificial Sequence: Synthetic oligonucleotide
uuuuuuuuggaagggacaauaag

SEQ ID NO: 1895 - RNA, 23 nt, Artificial Sequence
  Description of Artificial Sequence: Synthetic oligonucleotide
uuuuuuuuggaagggacaauaag

SEQ ID NO: 1896 - RNA, 23 nt, Artificial Sequence
  Description of Artificial Sequence: Synthetic oligonucleotide
cuuuuuuuuggaagggacaauaa

SEQ ID NO: 1897 - RNA, 23 nt, Artificial Sequence
  Description of Artificial Sequence: Synthetic oligonucleotide
cuuuuuuuuggaagggacaauaa

SEQ ID NO: 1898 - RNA, 23 nt, Artificial Sequence
  Description of Artificial Sequence: Synthetic oligonucleotide
ucuuuuuuuuggaagggacaaua

SEQ ID NO: 1899 - RNA, 23 nt, Artificial Sequence
  Description of Artificial Sequence: Synthetic oligonucleotide
ucuuuuuuuuggaagggacaaua

SEQ ID NO: 1900 - RNA, 23 nt, Artificial Sequence
  Description of Artificial Sequence: Synthetic oligonucleotide
cucuuuuuuuuggaagggacaau

SEQ ID NO: 1901 - RNA, 23 nt, Artificial Sequence
  Description of Artificial Sequence: Synthetic oligonucleotide
cucuuuuuuuuggaagggacaau

SEQ ID NO: 1902 - RNA, 23 nt, Artificial Sequence
  Description of Artificial Sequence: Synthetic oligonucleotide
ucucuuuuuuuuggaagggacaa

SEQ ID NO: 1903 - RNA, 23 nt, Artificial Sequence
  Description of Artificial Sequence: Synthetic oligonucleotide
ucucuuuuuuuuggaagggacaa

SEQ ID NO: 1904 - RNA, 23 nt, Artificial Sequence
  Description of Artificial Sequence: Synthetic oligonucleotide
uucucuuuuuuuuggaagggaca

SEQ ID NO: 1905 - RNA, 23 nt, Artificial Sequence
  Description of Artificial Sequence: Synthetic oligonucleotide
uucucuuuuuuuuggaagggaca

SEQ ID NO: 1906 - RNA, 23 nt, Artificial Sequence
  Description of Artificial Sequence: Synthetic oligonucleotide
auucucuuuuuuuuggaagggac

SEQ ID NO: 1907 - RNA, 23 nt, Artificial Sequence
  Description of Artificial Sequence: Synthetic oligonucleotide
auucucuuuuuuuuggaagggac

SEQ ID NO: 1908 - RNA, 23 nt, Artificial Sequence
  Description of Artificial Sequence: Synthetic oligonucleotide
gauucucuuuuuuuuggaaggga

SEQ ID NO: 1909 - RNA, 23 nt, Artificial Sequence
  Description of Artificial Sequence: Synthetic oligonucleotide
gauucucuuuuuuuuggaaggga

SEQ ID NO: 1910 - RNA, 23 nt, Artificial Sequence
  Description of Artificial Sequence: Synthetic oligonucleotide
ugauucucuuuuuuuuggaaggg

SEQ ID NO: 1911 - RNA, 23 nt, Artificial Sequence
  Description of Artificial Sequence: Synthetic oligonucleotide
ugauucucuuuuuuuuggaaggg

SEQ ID NO: 1912 - RNA, 23 nt, Artificial Sequence
  Description of Artificial Sequence: Synthetic oligonucleotide
uugauucucuuuuuuuuggaagg

SEQ ID NO: 1913 - RNA, 23 nt, Artificial Sequence
  Description of Artificial Sequence: Synthetic oligonucleotide
uugauucucuuuuuuuuggaagg

SEQ ID NO: 1914 - RNA, 23 nt, Artificial Sequence
  Description of Artificial Sequence: Synthetic oligonucleotide
uuugauucucuuuuuuuuggaag

SEQ ID NO: 1915 - RNA, 23 nt, Artificial Sequence
  Description of Artificial Sequence: Synthetic oligonucleotide
uuugauucucuuuuuuuuggaag

SEQ ID NO: 1916 - RNA, 23 nt, Artificial Sequence
  Description of Artificial Sequence: Synthetic oligonucleotide
uuuugauucucuuuuuuuuggaa

SEQ ID NO: 1917 - RNA, 23 nt, Artificial Sequence
  Description of Artificial Sequence: Synthetic oligonucleotide
uuuugauucucuuuuuuuuggaa

SEQ ID NO: 1918 - RNA, 23 nt, Artificial Sequence
  Description of Artificial Sequence: Synthetic oligonucleotide
auuuugauucucuuuuuuuugga

SEQ ID NO: 1919 - RNA, 23 nt, Artificial Sequence
  Description of Artificial Sequence: Synthetic oligonucleotide
auuuugauucucuuuuuuuugga

SEQ ID NO: 1920 - RNA, 23 nt, Artificial Sequence
  Description of Artificial Sequence: Synthetic oligonucleotide
aauuuugauucucuuuuuuuugg

SEQ ID NO: 1921 - RNA, 23 nt, Artificial Sequence
  Description of Artificial Sequence: Synthetic oligonucleotide
aauuuugauucucuuuuuuuugg

SEQ ID NO: 1922 - RNA, 23 nt, Artificial Sequence
  Description of Artificial Sequence: Synthetic oligonucleotide
aaauuuugauucucuuuuuuuug

SEQ ID NO: 1923 - RNA, 23 nt, Artificial Sequence
  Description of Artificial Sequence: Synthetic oligonucleotide
aaauuuugauucucuuuuuuuug

SEQ ID NO: 1924 - RNA, 23 nt, Artificial Sequence
  Description of Artificial Sequence: Synthetic oligonucleotide
aaaauuuugauucucuuuuuuuu

SEQ ID NO: 1925 - RNA, 23 nt, Artificial Sequence
  Description of Artificial Sequence: Synthetic oligonucleotide
aaaauuuugauucucuuuuuuuu

SEQ ID NO: 1926 - RNA, 23 nt, Artificial Sequence
  Description of Artificial Sequence: Synthetic oligonucleotide
uaaaauuuugauucucuuuuuuu

SEQ ID NO: 1927 - RNA, 23 nt, Artificial Sequence
  Description of Artificial Sequence: Synthetic oligonucleotide
uaaaauuuugauucucuuuuuuu

SEQ ID NO: 1928 - RNA, 23 nt, Artificial Sequence
  Description of Artificial Sequence: Synthetic oligonucleotide
guaaaauuuugauucucuuuuuu

SEQ ID NO: 1929 - RNA, 23 nt, Artificial Sequence
  Description of Artificial Sequence: Synthetic oligonucleotide
guaaaauuuugauucucuuuuuu

SEQ ID NO: 1930 - RNA, 23 nt, Artificial Sequence
  Description of Artificial Sequence: Synthetic oligonucleotide
uguaaaauuuugauucucuuuuu

SEQ ID NO: 1931 - RNA, 23 nt, Artificial Sequence
  Description of Artificial Sequence: Synthetic oligonucleotide
uguaaaauuuugauucucuuuuu

SEQ ID NO: 1932 - RNA, 23 nt, Artificial Sequence
  Description of Artificial Sequence: Synthetic oligonucleotide
uuguaaaauuuugauucucuuuu

SEQ ID NO: 1933 - RNA, 23 nt, Artificial Sequence
  Description of Artificial Sequence: Synthetic oligonucleotide
uuguaaaauuuugauucucuuuu

SEQ ID NO: 1934 - RNA, 23 nt, Artificial Sequence
  Description of Artificial Sequence: Synthetic oligonucleotide
uuuguaaaauuuugauucucuuu

SEQ ID NO: 1935 - RNA, 23 nt, Artificial Sequence
  Description of Artificial Sequence: Synthetic oligonucleotide
uuuguaaaauuuugauucucuuu

SEQ ID NO: 1936 - RNA, 23 nt, Artificial Sequence
  Description of Artificial Sequence: Synthetic oligonucleotide
cuuuguaaaauuuugauucucuu

SEQ ID NO: 1937 - RNA, 23 nt, Artificial Sequence
  Description of Artificial Sequence: Synthetic oligonucleotide
cuuuguaaaauuuugauucucuu

SEQ ID NO: 1938 - RNA, 23 nt, Artificial Sequence
  Description of Artificial Sequence: Synthetic oligonucleotide
ucuuuguaaaauuuugauucucu

SEQ ID NO: 1939 - RNA, 23 nt, Artificial Sequence
  Description of Artificial Sequence: Synthetic oligonucleotide
ucuuuguaaaauuuugauucucu

SEQ ID NO: 1940 - RNA, 23 nt, Artificial Sequence
  Description of Artificial Sequence: Synthetic oligonucleotide
uucuuuguaaaauuuugauucuc

SEQ ID NO: 1941 - RNA, 23 nt, Artificial Sequence
  Description of Artificial Sequence: Synthetic oligonucleotide
uucuuuguaaaauuuugauucuc

SEQ ID NO: 1942 - RNA, 23 nt, Artificial Sequence
  Description of Artificial Sequence: Synthetic oligonucleotide
auucuuuguaaaauuuugauucu

SEQ ID NO: 1943 - RNA, 23 nt, Artificial Sequence
  Description of Artificial Sequence: Synthetic oligonucleotide
auucuuuguaaaauuuugauucu

SEQ ID NO: 1944 - RNA, 23 nt, Artificial Sequence
  Description of Artificial Sequence: Synthetic oligonucleotide
gauucuuuguaaaauuuugauuc

SEQ ID NO: 1945 - RNA, 23 nt, Artificial Sequence
  Description of Artificial Sequence: Synthetic oligonucleotide
gauucuuuguaaaauuuugauuc

SEQ ID NO: 1946 - RNA, 23 nt, Artificial Sequence
  Description of Artificial Sequence: Synthetic oligonucleotide
ugauucuuuguaaaauuuugauu

SEQ ID NO: 1947 - RNA, 23 nt, Artificial Sequence
  Description of Artificial Sequence: Synthetic oligonucleotide
ugauucuuuguaaaauuuugauu

SEQ ID NO: 1948 - RNA, 23 nt, Artificial Sequence
  Description of Artificial Sequence: Synthetic oligonucleotide
uugauucuuuguaaaauuuugau

SEQ ID NO: 1949 - RNA, 23 nt, Artificial Sequence
  Description of Artificial Sequence: Synthetic oligonucleotide
uugauucuuuguaaaauuuugau

SEQ ID NO: 1950 - RNA, 23 nt, Artificial Sequence
  Description of Artificial Sequence: Synthetic oligonucleotide
uuugauucuuuguaaaauuuuga

SEQ ID NO: 1951 - RNA, 23 nt, Artificial Sequence
  Description of Artificial Sequence: Synthetic oligonucleotide
uuugauucuuuguaaaauuuuga

SEQ ID NO: 1952 - RNA, 23 nt, Artificial Sequence
  Description of Artificial Sequence: Synthetic oligonucleotide
cuuugauucuuuguaaaauuuug

SEQ ID NO: 1953 - RNA, 23 nt, Artificial Sequence
  Description of Artificial Sequence: Synthetic oligonucleotide
cuuugauucuuuguaaaauuuug

SEQ ID NO: 1954 - RNA, 23 nt, Artificial Sequence
  Description of Artificial Sequence: Synthetic oligonucleotide
ccuuugauucuuuguaaaauuuu

SEQ ID NO: 1955 - RNA, 23 nt, Artificial Sequence
  Description of Artificial Sequence: Synthetic oligonucleotide
ccuuugauucuuuguaaaauuuu

SEQ ID NO: 1956 - RNA, 23 nt, Artificial Sequence
  Description of Artificial Sequence: Synthetic oligonucleotide
uccuuugauucuuuguaaaauuu

SEQ ID NO: 1957 - RNA, 23 nt, Artificial Sequence
  Description of Artificial Sequence: Synthetic oligonucleotide
uccuuugauucuuuguaaaauuu

SEQ ID NO: 1958 - RNA, 23 nt, Artificial Sequence
  Description of Artificial Sequence: Synthetic oligonucleotide
uuccuuugauucuuuguaaaauu

SEQ ID NO: 1959 - RNA, 23 nt, Artificial Sequence
  Description of Artificial Sequence: Synthetic oligonucleotide
uuccuuugauucuuuguaaaauu

SEQ ID NO: 1960 - RNA, 23 nt, Artificial Sequence
  Description of Artificial Sequence: Synthetic oligonucleotide
auuccuuugauucuuuguaaaau

SEQ ID NO: 1961 - RNA, 23 nt, Artificial Sequence
  Description of Artificial Sequence: Synthetic oligonucleotide
auuccuuugauucuuuguaaaau

SEQ ID NO: 1962 - RNA, 23 nt, Artificial Sequence
  Description of Artificial Sequence: Synthetic oligonucleotide
aauuccuuugauucuuuguaaaa

SEQ ID NO: 1963 - RNA, 23 nt, Artificial Sequence
  Description of Artificial Sequence: Synthetic oligonucleotide
aauuccuuugauucuuuguaaaa

SEQ ID NO: 1964 - RNA, 23 nt, Artificial Sequence
  Description of Artificial Sequence: Synthetic oligonucleotide
gaauuccuuugauucuuuguaaa

SEQ ID NO: 1965 - RNA, 23 nt, Artificial Sequence
  Description of Artificial Sequence: Synthetic oligonucleotide
gaauuccuuugauucuuuguaaa

SEQ ID NO: 1966 - RNA, 23 nt, Artificial Sequence
  Description of Artificial Sequence: Synthetic oligonucleotide
agaauuccuuugauucuuuguaa

SEQ ID NO: 1967 - RNA, 23 nt, Artificial Sequence
  Description of Artificial Sequence: Synthetic oligonucleotide
agaauuccuuugauucuuuguaa

SEQ ID NO: 1968 - RNA, 23 nt, Artificial Sequence
  Description of Artificial Sequence: Synthetic oligonucleotide
uagaauuccuuugauucuuugua

SEQ ID NO: 1969 - RNA, 23 nt, Artificial Sequence
  Description of Artificial Sequence: Synthetic oligonucleotide
uagaauuccuuugauucuuugua

SEQ ID NO: 1970 - RNA, 23 nt, Artificial Sequence
  Description of Artificial Sequence: Synthetic oligonucleotide
cuagaauuccuuugauucuuugu

SEQ ID NO: 1971 - RNA, 23 nt, Artificial Sequence
  Description of Artificial Sequence: Synthetic oligonucleotide
cuagaauuccuuugauucuuugu

SEQ ID NO: 1972 - RNA, 23 nt, Artificial Sequence
  Description of Artificial Sequence: Synthetic oligonucleotide
ucuagaauuccuuugauucuuug

SEQ ID NO: 1973 - RNA, 23 nt, Artificial Sequence
  Description of Artificial Sequence: Synthetic oligonucleotide
ucuagaauuccuuugauucuuug

SEQ ID NO: 1974 - RNA, 23 nt, Artificial Sequence
  Description of Artificial Sequence: Synthetic oligonucleotide
uucuagaauuccuuugauucuuu

SEQ ID NO: 1975 - RNA, 23 nt, Artificial Sequence
  Description of Artificial Sequence: Synthetic oligonucleotide
uucuagaauuccuuugauucuuu

SEQ ID NO: 1976 - RNA, 23 nt, Artificial Sequence
  Description of Artificial Sequence: Synthetic oligonucleotide
uuucuagaauuccuuugauucuu

SEQ ID NO: 1977 - RNA, 23 nt, Artificial Sequence
  Description of Artificial Sequence: Synthetic oligonucleotide
uuucuagaauuccuuugauucuu

SEQ ID NO: 1978 - RNA, 23 nt, Artificial Sequence
  Description of Artificial Sequence: Synthetic oligonucleotide
cuuucuagaauuccuuugauucu

SEQ ID NO: 1979 - RNA, 23 nt, Artificial Sequence
  Description of Artificial Sequence: Synthetic oligonucleotide
cuuucuagaauuccuuugauucu

SEQ ID NO: 1980 - RNA, 23 nt, Artificial Sequence
  Description of Artificial Sequence: Synthetic oligonucleotide
acuuucuagaauuccuuugauuc

SEQ ID NO: 1981 - RNA, 23 nt, Artificial Sequence
  Description of Artificial Sequence: Synthetic oligonucleotide
acuuucuagaauuccuuugauuc

SEQ ID NO: 1982 - RNA, 23 nt, Artificial Sequence
  Description of Artificial Sequence: Synthetic oligonucleotide
uacuuucuagaauuccuuugauu

SEQ ID NO: 1983 - RNA, 23 nt, Artificial Sequence
  Description of Artificial Sequence: Synthetic oligonucleotide
uacuuucuagaauuccuuugauu

SEQ ID NO: 1984 - RNA, 23 nt, Artificial Sequence
  Description of Artificial Sequence: Synthetic oligonucleotide
auacuuucuagaauuccuuugau

SEQ ID NO: 1985 - RNA, 23 nt, Artificial Sequence
  Description of Artificial Sequence: Synthetic oligonucleotide
auacuuucuagaauuccuuugau

SEQ ID NO: 1986 - RNA, 23 nt, Artificial Sequence
  Description of Artificial Sequence: Synthetic oligonucleotide
gauacuuucuagaauuccuuuga

SEQ ID NO: 1987 - RNA, 23 nt, Artificial Sequence
  Description of Artificial Sequence: Synthetic oligonucleotide
gauacuuucuagaauuccuuuga

SEQ ID NO: 1988 - RNA, 23 nt, Artificial Sequence
  Description of Artificial Sequence: Synthetic oligonucleotide
agauacuuucuagaauuccuuug

SEQ ID NO: 1989 - RNA, 23 nt, Artificial Sequence
  Description of Artificial Sequence: Synthetic oligonucleotide
agauacuuucuagaauuccuuug

SEQ ID NO: 1990 - RNA, 23 nt, Artificial Sequence
  Description of Artificial Sequence: Synthetic oligonucleotide
cagauacuuucuagaauuccuuu

SEQ ID NO: 1991 - RNA, 23 nt, Artificial Sequence
  Description of Artificial Sequence: Synthetic oligonucleotide
cagauacuuucuagaauuccuuu

SEQ ID NO: 1992 - RNA, 23 nt, Artificial Sequence
  Description of Artificial Sequence: Synthetic oligonucleotide
ccagauacuuucuagaauuccuu

SEQ ID NO: 1993 - RNA, 23 nt, Artificial Sequence
  Description of Artificial Sequence: Synthetic oligonucleotide
ccagauacuuucuagaauuccuu

SEQ ID NO: 1994 - RNA, 23 nt, Artificial Sequence
  Description of Artificial Sequence: Synthetic oligonucleotide
cccagauacuuucuagaauuccu

SEQ ID NO: 1995 - RNA, 23 nt, Artificial Sequence
  Description of Artificial Sequence: Synthetic oligonucleotide
cccagauacuuucuagaauuccu

SEQ ID NO: 1996 - RNA, 23 nt, Artificial Sequence
  Description of Artificial Sequence: Synthetic oligonucleotide
gcccagauacuuucuagaauucc

SEQ ID NO: 1997 - RNA, 23 nt, Artificial Sequence
  Description of Artificial Sequence: Synthetic oligonucleotide
gcccagauacuuucuagaauucc

SEQ ID NO: 1998 - RNA, 23 nt, Artificial Sequence
  Description of Artificial Sequence: Synthetic oligonucleotide
ugcccagauacuuucuagaauuc

SEQ ID NO: 1999 - RNA, 23 nt, Artificial Sequence
  Description of Artificial Sequence: Synthetic oligonucleotide
ugcccagauacuuucuagaauuc

SEQ ID NO: 2000 - RNA, 23 nt, Artificial Sequence
  Description of Artificial Sequence: Synthetic oligonucleotide
cugcccagauacuuucuagaauu

SEQ ID NO: 2001 - RNA, 23 nt, Artificial Sequence
  Description of Artificial Sequence: Synthetic oligonucleotide
cugcccagauacuuucuagaauu

SEQ ID NO: 2002 - RNA, 23 nt, Artificial Sequence
  Description of Artificial Sequence: Synthetic oligonucleotide
ucugcccagauacuuucuagaau

SEQ ID NO: 2003 - RNA, 23 nt, Artificial Sequence
  Description of Artificial Sequence: Synthetic oligonucleotide
ucugcccagauacuuucuagaau

SEQ ID NO: 2004 - RNA, 23 nt, Artificial Sequence
  Description of Artificial Sequence: Synthetic oligonucleotide
uucugcccagauacuuucuagaa

SEQ ID NO: 2005 - RNA, 23 nt, Artificial Sequence
  Description of Artificial Sequence: Synthetic oligonucleotide
uucugcccagauacuuucuagaa

SEQ ID NO: 2006 - RNA, 23 nt, Artificial Sequence
  Description of Artificial Sequence: Synthetic oligonucleotide
guucugcccagauacuuucuaga

SEQ ID NO: 2007 - RNA, 23 nt, Artificial Sequence
  Description of Artificial Sequence: Synthetic oligonucleotide
guucugcccagauacuuucuaga

SEQ ID NO: 2008 - RNA, 23 nt, Artificial Sequence
  Description of Artificial Sequence: Synthetic oligonucleotide
cguucugcccagauacuuucuag

SEQ ID NO: 2009 - RNA, 23 nt, Artificial Sequence
  Description of Artificial Sequence: Synthetic oligonucleotide
cguucugcccagauacuuucuag

SEQ ID NO: 2010 - RNA, 23 nt, Artificial Sequence
  Description of Artificial Sequence: Synthetic oligonucleotide
gcguucugcccagauacuuucua

SEQ ID NO: 2011 - RNA, 23 nt, Artificial Sequence
  Description of Artificial Sequence: Synthetic oligonucleotide
gcguucugcccagauacuuucua

SEQ ID NO: 2012 - RNA, 23 nt, Artificial Sequence
  Description of Artificial Sequence: Synthetic oligonucleotide
agcguucugcccagauacuuucu

SEQ ID NO: 2013 - RNA, 23 nt, Artificial Sequence
  Description of Artificial Sequence: Synthetic oligonucleotide
agcguucugcccagauacuuucu

SEQ ID NO: 2014 - RNA, 23 nt, Artificial Sequence
  Description of Artificial Sequence: Synthetic oligonucleotide
uagcguucugcccagauacuuuc

SEQ ID NO: 2015 - RNA, 23 nt, Artificial Sequence
  Description of Artificial Sequence: Synthetic oligonucleotide
uagcguucugcccagauacuuuc

SEQ ID NO: 2016 - RNA, 23 nt, Artificial Sequence
  Description of Artificial Sequence: Synthetic oligonucleotide
cuagcguucugcccagauacuuu

SEQ ID NO: 2017 - RNA, 23 nt, Artificial Sequence
  Description of Artificial Sequence: Synthetic oligonucleotide
cuagcguucugcccagauacuuu

SEQ ID NO: 2018 - RNA, 23 nt, Artificial Sequence
  Description of Artificial Sequence: Synthetic oligonucleotide
ccuagcguucugcccagauacuu

SEQ ID NO: 2019 - RNA, 23 nt, Artificial Sequence
  Description of Artificial Sequence: Synthetic oligonucleotide
ccuagcguucugcccagauacuu

SEQ ID NO: 2020 - RNA, 23 nt, Artificial Sequence
  Description of Artificial Sequence: Synthetic oligonucleotide
uccuagcguucugcccagauacu

SEQ ID NO: 2021 - RNA, 23 nt, Artificial Sequence
  Description of Artificial Sequence: Synthetic oligonucleotide
uccuagcguucugcccagauacu

SEQ ID NO: 2022 - RNA, 23 nt, Artificial Sequence
  Description of Artificial Sequence: Synthetic oligonucleotide
cuccuagcguucugcccagauac

SEQ ID NO: 2023 - RNA, 23 nt, Artificial Sequence
  Description of Artificial Sequence: Synthetic oligonucleotide
cuccuagcguucugcccagauac

SEQ ID NO: 2024 - RNA, 23 nt, Artificial Sequence
  Description of Artificial Sequence: Synthetic oligonucleotide
ucuccuagcguucugcccagaua

SEQ ID NO: 2025 - RNA, 23 nt, Artificial Sequence
  Description of Artificial Sequence: Synthetic oligonucleotide
ucuccuagcguucugcccagaua

SEQ ID NO: 2026 - RNA, 23 nt, Artificial Sequence
  Description of Artificial Sequence: Synthetic oligonucleotide
cucuccuagcguucugcccagau

SEQ ID NO: 2027 - RNA, 23 nt, Artificial Sequence
  Description of Artificial Sequence: Synthetic oligonucleotide
cucuccuagcguucugcccagau

SEQ ID NO: 2028 - RNA, 23 nt, Artificial Sequence
  Description of Artificial Sequence: Synthetic oligonucleotide
ucucuccuagcguucugcccaga

SEQ ID NO: 2029 - RNA, 23 nt, Artificial Sequence
  Description of Artificial Sequence: Synthetic oligonucleotide
ucucuccuagcguucugcccaga

SEQ ID NO: 2030 - RNA, 23 nt, Artificial Sequence
  Description of Artificial Sequence: Synthetic oligonucleotide
aucucuccuagcguucugcccag

SEQ ID NO: 2031 - RNA, 23 nt, Artificial Sequence
  Description of Artificial Sequence: Synthetic oligonucleotide
aucucuccuagcguucugcccag

SEQ ID NO: 2032 - RNA, 23 nt, Artificial Sequence
  Description of Artificial Sequence: Synthetic oligonucleotide
gaucucuccuagcguucugccca

SEQ ID NO: 2033 - RNA, 23 nt, Artificial Sequence
  Description of Artificial Sequence: Synthetic oligonucleotide
gaucucuccuagcguucugccca

SEQ ID NO: 2034 - RNA, 23 nt, Artificial Sequence
  Description of Artificial Sequence: Synthetic oligonucleotide
ggaucucuccuagcguucugccc

SEQ ID NO: 2035 - RNA, 23 nt, Artificial Sequence
  Description of Artificial Sequence: Synthetic oligonucleotide
ggaucucuccuagcguucugccc

SEQ ID NO: 2036 - RNA, 23 nt, Artificial Sequence
  Description of Artificial Sequence: Synthetic oligonucleotide
uggaucucuccuagcguucugcc

SEQ ID NO: 2037 - RNA, 23 nt, Artificial Sequence
  Description of Artificial Sequence: Synthetic oligonucleotide
uggaucucuccuagcguucugcc

SEQ ID NO: 2038 - RNA, 23 nt, Artificial Sequence
  Description of Artificial Sequence: Synthetic oligonucleotide
uuggaucucuccuagcguucugc

SEQ ID NO: 2039 - RNA, 23 nt, Artificial Sequence
  Description of Artificial Sequence: Synthetic oligonucleotide
uuggaucucuccuagcguucugc

SEQ ID NO: 2040 - RNA, 23 nt, Artificial Sequence
  Description of Artificial Sequence: Synthetic oligonucleotide
uuuggaucucuccuagcguucug

SEQ ID NO: 2041 - RNA, 23 nt, Artificial Sequence
  Description of Artificial Sequence: Synthetic oligonucleotide
uuuggaucucuccuagcguucug

SEQ ID NO: 2042 - RNA, 23 nt, Artificial Sequence
  Description of Artificial Sequence: Synthetic oligonucleotide
auuuggaucucuccuagcguucu

SEQ ID NO: 2043 - RNA, 23 nt, Artificial Sequence
  Description of Artificial Sequence: Synthetic oligonucleotide
auuuggaucucuccuagcguucu

SEQ ID NO: 2044 - RNA, 23 nt, Artificial Sequence
  Description of Artificial Sequence: Synthetic oligonucleotide
aauuuggaucucuccuagcguuc

SEQ ID NO: 2045 - RNA, 23 nt, Artificial Sequence
  Description of Artificial Sequence: Synthetic oligonucleotide
aauuuggaucucuccuagcguuc

SEQ ID NO: 2046 - RNA, 23 nt, Artificial Sequence
  Description of Artificial Sequence: Synthetic oligonucleotide
aaauuuggaucucuccuagcguu

SEQ ID NO: 2047 - RNA, 23 nt, Artificial Sequence
  Description of Artificial Sequence: Synthetic oligonucleotide
aaauuuggaucucuccuagcguu

SEQ ID NO: 2048 - RNA, 23 nt, Artificial Sequence
  Description of Artificial Sequence: Synthetic oligonucleotide
gaaauuuggaucucuccuagcgu

SEQ ID NO: 2049 - RNA, 23 nt, Artificial Sequence
  Description of Artificial Sequence: Synthetic oligonucleotide
gaaauuuggaucucuccuagcgu

SEQ ID NO: 2050 - RNA, 23 nt, Artificial Sequence
  Description of Artificial Sequence: Synthetic oligonucleotide
ggaaauuuggaucucuccuagcg

SEQ ID NO: 2051 - RNA, 23 nt, Artificial Sequence
  Description of Artificial Sequence: Synthetic oligonucleotide
ggaaauuuggaucucuccuagcg

SEQ ID NO: 2052 - RNA, 23 nt, Artificial Sequence
  Description of Artificial Sequence: Synthetic oligonucleotide
uggaaauuuggaucucuccuagc

SEQ ID NO: 2053 - RNA, 23 nt, Artificial Sequence
  Description of Artificial Sequence: Synthetic oligonucleotide
uggaaauuuggaucucuccuagc

SEQ ID NO: 2054 - RNA, 23 nt, Artificial Sequence
  Description of Artificial Sequence: Synthetic oligonucleotide
auggaaauuuggaucucuccuag

SEQ ID NO: 2055 - RNA, 23 nt, Artificial Sequence
  Description of Artificial Sequence: Synthetic oligonucleotide
auggaaauuuggaucucuccuag

SEQ ID NO: 2056 - RNA, 23 nt, Artificial Sequence
  Description of Artificial Sequence: Synthetic oligonucleotide
aauggaaauuuggaucucuccua

SEQ ID NO: 2057 - RNA, 23 nt, Artificial Sequence
  Description of Artificial Sequence: Synthetic oligonucleotide
aauggaaauuuggaucucuccua

SEQ ID NO: 2058 - RNA, 23 nt, Artificial Sequence
  Description of Artificial Sequence: Synthetic oligonucleotide
caauggaaauuuggaucucuccu

SEQ ID NO: 2059 - RNA, 23 nt, Artificial Sequence
  Description of Artificial Sequence: Synthetic oligonucleotide
caauggaaauuuggaucucuccu

SEQ ID NO: 2060 - RNA, 23 nt, Artificial Sequence
  Description of Artificial Sequence: Synthetic oligonucleotide
acaauggaaauuuggaucucucc

SEQ ID NO: 2061 - RNA, 23 nt, Artificial Sequence
  Description of Artificial Sequence: Synthetic oligonucleotide
acaauggaaauuuggaucucucc

SEQ ID NO: 2062 - RNA, 23 nt, Artificial Sequence
  Description of Artificial Sequence: Synthetic oligonucleotide
gacaauggaaauuuggaucucuc

SEQ ID NO: 2063 - RNA, 23 nt, Artificial Sequence
  Description of Artificial Sequence: Synthetic oligonucleotide
gacaauggaaauuuggaucucuc

SEQ ID NO: 2064 - RNA, 23 nt, Artificial Sequence
  Description of Artificial Sequence: Synthetic oligonucleotide
agacaauggaaauuuggaucucu

SEQ ID NO: 2065 - RNA, 23 nt, Artificial Sequence
  Description of Artificial Sequence: Synthetic oligonucleotide
agacaauggaaauuuggaucucu

SEQ ID NO: 2066 - RNA, 23 nt, Artificial Sequence
  Description of Artificial Sequence: Synthetic oligonucleotide
aagacaauggaaauuuggaucuc

SEQ ID NO: 2067 - RNA, 23 nt, Artificial Sequence
  Description of Artificial Sequence: Synthetic oligonucleotide
aagacaauggaaauuuggaucuc

SEQ ID NO: 2068 - RNA, 23 nt, Artificial Sequence
  Description of Artificial Sequence: Synthetic oligonucleotide
caagacaauggaaauuuggaucu

SEQ ID NO: 2069 - RNA, 23 nt, Artificial Sequence
  Description of Artificial Sequence: Synthetic oligonucleotide
caagacaauggaaauuuggaucu

SEQ ID NO: 2070 - RNA, 23 nt, Artificial Sequence
  Description of Artificial Sequence: Synthetic oligonucleotide
gcaagacaauggaaauuuggauc

SEQ ID NO: 2071 - RNA, 23 nt, Artificial Sequence
  Description of Artificial Sequence: Synthetic oligonucleotide
gcaagacaauggaaauuuggauc

SEQ ID NO: 2072 - RNA, 23 nt, Artificial Sequence
  Description of Artificial Sequence: Synthetic oligonucleotide
ugcaagacaauggaaauuuggau

SEQ ID NO: 2073 - RNA, 23 nt, Artificial Sequence
  Description of Artificial Sequence: Synthetic oligonucleotide
ugcaagacaauggaaauuuggau

SEQ ID NO: 2074 - RNA, 23 nt, Artificial Sequence
  Description of Artificial Sequence: Synthetic oligonucleotide
uugcaagacaauggaaauuugga

SEQ ID NO: 2075 - RNA, 23 nt, Artificial Sequence
  Description of Artificial Sequence: Synthetic oligonucleotide
uugcaagacaauggaaauuugga

SEQ ID NO: 2076 - RNA, 23 nt, Artificial Sequence
  Description of Artificial Sequence: Synthetic oligonucleotide
cuugcaagacaauggaaauuugg

SEQ ID NO: 2077 - RNA, 23 nt, Artificial Sequence
  Description of Artificial Sequence: Synthetic oligonucleotide
cuugcaagacaauggaaauuugg

SEQ ID NO: 2078 - RNA, 23 nt, Artificial Sequence
  Description of Artificial Sequence: Synthetic oligonucleotide
gcuugcaagacaauggaaauuug

SEQ ID NO: 2079 - RNA, 23 nt, Artificial Sequence
  Description of Artificial Sequence: Synthetic oligonucleotide
gcuugcaagacaauggaaauuug

SEQ ID NO: 2080 - RNA, 23 nt, Artificial Sequence
  Description of Artificial Sequence: Synthetic oligonucleotide
ugcuugcaagacaauggaaauuu

SEQ ID NO: 2081 - RNA, 23 nt, Artificial Sequence
  Description of Artificial Sequence: Synthetic oligonucleotide
ugcuugcaagacaauggaaauuu

SEQ ID NO: 2082 - RNA, 23 nt, Artificial Sequence
  Description of Artificial Sequence: Synthetic oligonucleotide
uugcuugcaagacaauggaaauu

SEQ ID NO: 2083 - RNA, 23 nt, Artificial Sequence
  Description of Artificial Sequence: Synthetic oligonucleotide
uugcuugcaagacaauggaaauu

SEQ ID NO: 2084 - RNA, 23 nt, Artificial Sequence
  Description of Artificial Sequence: Synthetic oligonucleotide
uuugcuugcaagacaauggaaau

SEQ ID NO: 2085 - RNA, 23 nt, Artificial Sequence
  Description of Artificial Sequence: Synthetic oligonucleotide
uuugcuugcaagacaauggaaau

SEQ ID NO: 2086 - RNA, 23 nt, Artificial Sequence
  Description of Artificial Sequence: Synthetic oligonucleotide
cuuugcuugcaagacaauggaaa

SEQ ID NO: 2087 - RNA, 23 nt, Artificial Sequence
  Description of Artificial Sequence: Synthetic oligonucleotide
cuuugcuugcaagacaauggaaa

SEQ ID NO: 2088 - RNA, 23 nt, Artificial Sequence
  Description of Artificial Sequence: Synthetic oligonucleotide
gcuuugcuugcaagacaauggaa

SEQ ID NO: 2089 - RNA, 23 nt, Artificial Sequence
  Description of Artificial Sequence: Synthetic oligonucleotide
gcuuugcuugcaagacaauggaa

SEQ ID NO: 2090 - RNA, 23 nt, Artificial Sequence
  Description of Artificial Sequence: Synthetic oligonucleotide
ugcuuugcuugcaagacaaugga

SEQ ID NO: 2091 - RNA, 23 nt, Artificial Sequence
  Description of Artificial Sequence: Synthetic oligonucleotide
ugcuuugcuugcaagacaaugga

SEQ ID NO: 2092 - RNA, 23 nt, Artificial Sequence
  Description of Artificial Sequence: Synthetic oligonucleotide
gugcuuugcuugcaagacaaugg

SEQ ID NO: 2093 - RNA, 23 nt, Artificial Sequence
  Description of Artificial Sequence: Synthetic oligonucleotide
gugcuuugcuugcaagacaaugg

SEQ ID NO: 2094 - RNA, 23 nt, Artificial Sequence
  Description of Artificial Sequence: Synthetic oligonucleotide
cgugcuuugcuugcaagacaaug

SEQ ID NO: 2095 - RNA, 23 nt, Artificial Sequence
  Description of Artificial Sequence: Synthetic oligonucleotide
cgugcuuugcuugcaagacaaug

SEQ ID NO: 2096 - RNA, 23 nt, Artificial Sequence
  Description of Artificial Sequence: Synthetic oligonucleotide
acgugcuuugcuugcaagacaau

SEQ ID NO: 2097 - RNA, 23 nt, Artificial Sequence
  Description of Artificial Sequence: Synthetic oligonucleotide
acgugcuuugcuugcaagacaau

SEQ ID NO: 2098 - RNA, 23 nt, Artificial Sequence
  Description of Artificial Sequence: Synthetic oligonucleotide
uacgugcuuugcuugcaagacaa

SEQ ID NO: 2099 - RNA, 23 nt, Artificial Sequence
  Description of Artificial Sequence: Synthetic oligonucleotide
uacgugcuuugcuugcaagacaa

SEQ ID NO: 2100 - RNA, 23 nt, Artificial Sequence
  Description of Artificial Sequence: Synthetic oligonucleotide
auacgugcuuugcuugcaagaca

SEQ ID NO: 2101 - RNA, 23 nt, Artificial Sequence
  Description of Artificial Sequence: Synthetic oligonucleotide
auacgugcuuugcuugcaagaca

SEQ ID NO: 2102 - RNA, 23 nt, Artificial Sequence
  Description of Artificial Sequence: Synthetic oligonucleotide
aauacgugcuuugcuugcaagac

SEQ ID NO: 2103 - RNA, 23 nt, Artificial Sequence
  Description of Artificial Sequence: Synthetic oligonucleotide
aauacgugcuuugcuugcaagac

SEQ ID NO: 2104 - RNA, 23 nt, Artificial Sequence
  Description of Artificial Sequence: Synthetic oligonucleotide
uaauacgugcuuugcuugcaaga

SEQ ID NO: 2105 - RNA, 23 nt, Artificial Sequence
  Description of Artificial Sequence: Synthetic oligonucleotide
uaauacgugcuuugcuugcaaga

SEQ ID NO: 2106 - RNA, 23 nt, Artificial Sequence
  Description of Artificial Sequence: Synthetic oligonucleotide
uuaauacgugcuuugcuugcaag

SEQ ID NO: 2107 - RNA, 23 nt, Artificial Sequence
  Description of Artificial Sequence: Synthetic oligonucleotide
uuaauacgugcuuugcuugcaag

SEQ ID NO: 2108 - RNA, 23 nt, Artificial Sequence
  Description of Artificial Sequence: Synthetic oligonucleotide
uuuaauacgugcuuugcuugcaa

SEQ ID NO: 2109 - RNA, 23 nt, Artificial Sequence
  Description of Artificial Sequence: Synthetic oligonucleotide
uuuaauacgugcuuugcuugcaa

SEQ ID NO: 2110 - RNA, 23 nt, Artificial Sequence
  Description of Artificial Sequence: Synthetic oligonucleotide
auuuaauacgugcuuugcuugca

SEQ ID NO: 2111 - RNA, 23 nt, Artificial Sequence
  Description of Artificial Sequence: Synthetic oligonucleotide
auuuaauacgugcuuugcuugca

SEQ ID NO: 2112 - RNA, 23 nt, Artificial Sequence
  Description of Artificial Sequence: Synthetic oligonucleotide
uauuuaauacgugcuuugcuugc

SEQ ID NO: 2113 - RNA, 23 nt, Artificial Sequence
  Description of Artificial Sequence: Synthetic oligonucleotide
uauuuaauacgugcuuugcuugc

SEQ ID NO: 2114 - RNA, 23 nt, Artificial Sequence
  Description of Artificial Sequence: Synthetic oligonucleotide
auauuuaauacgugcuuugcuug

SEQ ID NO: 2115 - RNA, 23 nt, Artificial Sequence
  Description of Artificial Sequence: Synthetic oligonucleotide
auauuuaauacgugcuuugcuug

SEQ ID NO: 2116 - RNA, 23 nt, Artificial Sequence
  Description of Artificial Sequence: Synthetic oligonucleotide
cauauuuaauacgugcuuugcuu

SEQ ID NO: 2117 - RNA, 23 nt, Artificial Sequence
  Description of Artificial Sequence: Synthetic oligonucleotide
cauauuuaauacgugcuuugcuu

SEQ ID NO: 2118 - RNA, 23 nt, Artificial Sequence
  Description of Artificial Sequence: Synthetic oligonucleotide
ucauauuuaauacgugcuuugcu

SEQ ID NO: 2119 - RNA, 23 nt, Artificial Sequence
  Description of Artificial Sequence: Synthetic oligonucleotide
ucauauuuaauacgugcuuugcu

SEQ ID NO: 2120 - RNA, 23 nt, Artificial Sequence
  Description of Artificial Sequence: Synthetic oligonucleotide
aucauauuuaauacgugcuuugc

SEQ ID NO: 2121 - RNA, 23 nt, Artificial Sequence
  Description of Artificial Sequence: Synthetic oligonucleotide
aucauauuuaauacgugcuuugc

SEQ ID NO: 2122 - RNA, 23 nt, Artificial Sequence
  Description of Artificial Sequence: Synthetic oligonucleotide
gaucauauuuaauacgugcuuug

SEQ ID NO: 2123 - RNA, 23 nt, Artificial Sequence
  Description of Artificial Sequence: Synthetic oligonucleotide
gaucauauuuaauacgugcuuug

SEQ ID NO: 2124 - RNA, 23 nt, Artificial Sequence
  Description of Artificial Sequence: Synthetic oligonucleotide
agaucauauuuaauacgugcuuu

SEQ ID NO: 2125 - RNA, 23 nt, Artificial Sequence
  Description of Artificial Sequence: Synthetic oligonucleotide
agaucauauuuaauacgugcuuu

SEQ ID NO: 2126 - RNA, 23 nt, Artificial Sequence
  Description of Artificial Sequence: Synthetic oligonucleotide
cagaucauauuuaauacgugcuu

SEQ ID NO: 2127 - RNA, 23 nt, Artificial Sequence
  Description of Artificial Sequence: Synthetic oligonucleotide
cagaucauauuuaauacgugcuu

SEQ ID NO: 2128 - RNA, 23 nt, Artificial Sequence
  Description of Artificial Sequence: Synthetic oligonucleotide
gcagaucauauuuaauacgugcu

SEQ ID NO: 2129 - RNA, 23 nt, Artificial Sequence
  Description of Artificial Sequence: Synthetic oligonucleotide
gcagaucauauuuaauacgugcu

SEQ ID NO: 2130 - RNA, 23 nt, Artificial Sequence
  Description of Artificial Sequence: Synthetic oligonucleotide
ugcagaucauauuuaauacgugc

SEQ ID NO: 2131 - RNA, 23 nt, Artificial Sequence
  Description of Artificial Sequence: Synthetic oligonucleotide
ugcagaucauauuuaauacgugc

SEQ ID NO: 2132 - RNA, 23 nt, Artificial Sequence
  Description of Artificial Sequence: Synthetic oligonucleotide
cugcagaucauauuuaauacgug

SEQ ID NO: 2133 - RNA, 23 nt, Artificial Sequence
  Description of Artificial Sequence: Synthetic oligonucleotide
cugcagaucauauuuaauacgug

SEQ ID NO: 2134 - RNA, 23 nt, Artificial Sequence
  Description of Artificial Sequence: Synthetic oligonucleotide
gcugcagaucauauuuaauacgu

SEQ ID NO: 2135 - RNA, 23 nt, Artificial Sequence
  Description of Artificial Sequence: Synthetic oligonucleotide
gcugcagaucauauuuaauacgu

SEQ ID NO: 2136 - RNA, 23 nt, Artificial Sequence
  Description of Artificial Sequence: Synthetic oligonucleotide
ggcugcagaucauauuuaauacg

SEQ ID NO: 2137 - RNA, 23 nt, Artificial Sequence
  Description of Artificial Sequence: Synthetic oligonucleotide
ggcugcagaucauauuuaauacg

SEQ ID NO: 2138 - RNA, 23 nt, Artificial Sequence
  Description of Artificial Sequence: Synthetic oligonucleotide
uggcugcagaucauauuuaauac

SEQ ID NO: 2139 - RNA, 23 nt, Artificial Sequence
  Description of Artificial Sequence: Synthetic oligonucleotide
uggcugcagaucauauuuaauac

SEQ ID NO: 2140 - RNA, 23 nt, Artificial Sequence
  Description of Artificial Sequence: Synthetic oligonucleotide
auggcugcagaucauauuuaaua

SEQ ID NO: 2141 - RNA, 23 nt, Artificial Sequence
  Description of Artificial Sequence: Synthetic oligonucleotide
auggcugcagaucauauuuaaua

SEQ ID NO: 2142 - RNA, 23 nt, Artificial Sequence
  Description of Artificial Sequence: Synthetic oligonucleotide
aauggcugcagaucauauuuaau

SEQ ID NO: 2143 - RNA, 23 nt, Artificial Sequence
  Description of Artificial Sequence: Synthetic oligonucleotide
aauggcugcagaucauauuuaau

SEQ ID NO: 2144 - RNA, 23 nt, Artificial Sequence
  Description of Artificial Sequence: Synthetic oligonucleotide
uaauggcugcagaucauauuuaa

SEQ ID NO: 2145 - RNA, 23 nt, Artificial Sequence
  Description of Artificial Sequence: Synthetic oligonucleotide
uaauggcugcagaucauauuuaa

SEQ ID NO: 2146 - RNA, 23 nt, Artificial Sequence
  Description of Artificial Sequence: Synthetic oligonucleotide
uuaauggcugcagaucauauuua

SEQ ID NO: 2147 - RNA, 23 nt, Artificial Sequence
  Description of Artificial Sequence: Synthetic oligonucleotide
uuaauggcugcagaucauauuua

SEQ ID NO: 2148 - RNA, 23 nt, Artificial Sequence
  Description of Artificial Sequence: Synthetic oligonucleotide
uuuaauggcugcagaucauauuu

SEQ ID NO: 2149 - RNA, 23 nt, Artificial Sequence
  Description of Artificial Sequence: Synthetic oligonucleotide
uuuaauggcugcagaucauauuu

SEQ ID NO: 2150 - RNA, 23 nt, Artificial Sequence
  Description of Artificial Sequence: Synthetic oligonucleotide
uuuuaauggcugcagaucauauu

SEQ ID NO: 2151 - RNA, 23 nt, Artificial Sequence
  Description of Artificial Sequence: Synthetic oligonucleotide
uuuuaauggcugcagaucauauu

SEQ ID NO: 2152 - RNA, 23 nt, Artificial Sequence
  Description of Artificial Sequence: Synthetic oligonucleotide
uuuuuaauggcugcagaucauau

SEQ ID NO: 2153 - RNA, 23 nt, Artificial Sequence
  Description of Artificial Sequence: Synthetic oligonucleotide
uuuuuaauggcugcagaucauau

SEQ ID NO: 2154 - RNA, 23 nt, Artificial Sequence
  Description of Artificial Sequence: Synthetic oligonucleotide
cuuuuuaauggcugcagaucaua

SEQ ID NO: 2155 - RNA, 23 nt, Artificial Sequence
  Description of Artificial Sequence: Synthetic oligonucleotide
cuuuuuaauggcugcagaucaua

SEQ ID NO: 2156 - RNA, 23 nt, Artificial Sequence
  Description of Artificial Sequence: Synthetic oligonucleotide
ucuuuuuaauggcugcagaucau

SEQ ID NO: 2157 - RNA, 23 nt, Artificial Sequence
  Description of Artificial Sequence: Synthetic oligonucleotide
ucuuuuuaauggcugcagaucau

SEQ ID NO: 2158 - RNA, 23 nt, Artificial Sequence
  Description of Artificial Sequence: Synthetic oligonucleotide
gucuuuuuaauggcugcagauca

SEQ ID NO: 2159 - RNA, 23 nt, Artificial Sequence
  Description of Artificial Sequence: Synthetic oligonucleotide
gucuuuuuaauggcugcagauca

SEQ ID NO: 2160 - RNA, 23 nt, Artificial Sequence
  Description of Artificial Sequence: Synthetic oligonucleotide
ugucuuuuuaauggcugcagauc

SEQ ID NO: 2161 - RNA, 23 nt, Artificial Sequence
  Description of Artificial Sequence: Synthetic oligonucleotide
ugucuuuuuaauggcugcagauc

SEQ ID NO: 2162 - RNA, 23 nt, Artificial Sequence
  Description of Artificial Sequence: Synthetic oligonucleotide
gugucuuuuuaauggcugcagau

SEQ ID NO: 2163 - RNA, 23 nt, Artificial Sequence
  Description of Artificial Sequence: Synthetic oligonucleotide
gugucuuuuuaauggcugcagau

SEQ ID NO: 2164 - RNA, 23 nt, Artificial Sequence
  Description of Artificial Sequence: Synthetic oligonucleotide
ugugucuuuuuaauggcugcaga

SEQ ID NO: 2165 - RNA, 23 nt, Artificial Sequence
  Description of Artificial Sequence: Synthetic oligonucleotide
ugugucuuuuuaauggcugcaga

SEQ ID NO: 2166 - RNA, 23 nt, Artificial Sequence
  Description of Artificial Sequence: Synthetic oligonucleotide
augugucuuuuuaauggcugcag

SEQ ID NO: 2167 - RNA, 23 nt, Artificial Sequence
  Description of Artificial Sequence: Synthetic oligonucleotide
augugucuuuuuaauggcugcag

SEQ ID NO: 2168 - RNA, 23 nt, Artificial Sequence
  Description of Artificial Sequence: Synthetic oligonucleotide
aaugugucuuuuuaauggcugca

SEQ ID NO: 2169 - RNA, 23 nt, Artificial Sequence
  Description of Artificial Sequence: Synthetic oligonucleotide
aaugugucuuuuuaauggcugca

SEQ ID NO: 2170 - RNA, 23 nt, Artificial Sequence
  Description of Artificial Sequence: Synthetic oligonucleotide
gaaugugucuuuuuaauggcugc

SEQ ID NO: 2171 - RNA, 23 nt, Artificial Sequence
  Description of Artificial Sequence: Synthetic oligonucleotide
gaaugugucuuuuuaauggcugc

SEQ ID NO: 2172 - RNA, 23 nt, Artificial Sequence
  Description of Artificial Sequence: Synthetic oligonucleotide
agaaugugucuuuuuaauggcug

SEQ ID NO: 2173 - RNA, 23 nt, Artificial Sequence
  Description of Artificial Sequence: Synthetic oligonucleotide
agaaugugucuuuuuaauggcug

SEQ ID NO: 2174 - RNA, 23 nt, Artificial Sequence
  Description of Artificial Sequence: Synthetic oligonucleotide
cagaaugugucuuuuuaauggcu

SEQ ID NO: 2175 - RNA, 23 nt, Artificial Sequence
  Description of Artificial Sequence: Synthetic oligonucleotide
cagaaugugucuuuuuaauggcu

SEQ ID NO: 2176 - RNA, 23 nt, Artificial Sequence
  Description of Artificial Sequence: Synthetic oligonucleotide
acagaaugugucuuuuuaauggc

SEQ ID NO: 2177 - RNA, 23 nt, Artificial Sequence
  Description of Artificial Sequence: Synthetic oligonucleotide
acagaaugugucuuuuuaauggc

SEQ ID NO: 2178 - RNA, 23 nt, Artificial Sequence
  Description of Artificial Sequence: Synthetic oligonucleotide
uacagaaugugucuuuuuaaugg

SEQ ID NO: 2179 - RNA, 23 nt, Artificial Sequence
  Description of Artificial Sequence: Synthetic oligonucleotide
uacagaaugugucuuuuuaaugg

SEQ ID NO: 2180 - RNA, 23 nt, Artificial Sequence
  Description of Artificial Sequence: Synthetic oligonucleotide
uuacagaaugugucuuuuuaaug

SEQ ID NO: 2181 - RNA, 23 nt, Artificial Sequence
  Description of Artificial Sequence: Synthetic oligonucleotide
uuacagaaugugucuuuuuaaug

SEQ ID NO: 2182 - RNA, 23 nt, Artificial Sequence
  Description of Artificial Sequence: Synthetic oligonucleotide
uuuacagaaugugucuuuuuaau

SEQ ID NO: 2183 - RNA, 23 nt, Artificial Sequence
  Description of Artificial Sequence: Synthetic oligonucleotide
uuuacagaaugugucuuuuuaau

SEQ ID NO: 2184 - RNA, 23 nt, Artificial Sequence
  Description of Artificial Sequence: Synthetic oligonucleotide
uuuuacagaaugugucuuuuuaa

SEQ ID NO: 2185 - RNA, 23 nt, Artificial Sequence
  Description of Artificial Sequence: Synthetic oligonucleotide
uuuuacagaaugugucuuuuuaa

SEQ ID NO: 2186 - RNA, 23 nt, Artificial Sequence
  Description of Artificial Sequence: Synthetic oligonucleotide
uuuuuacagaaugugucuuuuua

SEQ ID NO: 2187 - RNA, 23 nt, Artificial Sequence
  Description of Artificial Sequence: Synthetic oligonucleotide
uuuuuacagaaugugucuuuuua

SEQ ID NO: 2188 - RNA, 23 nt, Artificial Sequence
  Description of Artificial Sequence: Synthetic oligonucleotide
uuuuuuacagaaugugucuuuuu

SEQ ID NO: 2189 - RNA, 23 nt, Artificial Sequence
  Description of Artificial Sequence: Synthetic oligonucleotide
uuuuuuacagaaugugucuuuuu

SEQ ID NO: 2190 - RNA, 23 nt, Artificial Sequence
  Description of Artificial Sequence: Synthetic oligonucleotide
uuuuuuuacagaaugugucuuuu

SEQ ID NO: 2191 - RNA, 23 nt, Artificial Sequence
  Description of Artificial Sequence: Synthetic oligonucleotide
uuuuuuuacagaaugugucuuuu

SEQ ID NO: 2192 - RNA, 23 nt, Artificial Sequence
  Description of Artificial Sequence: Synthetic oligonucleotide
uuuuuuuuacagaaugugucuuu

SEQ ID NO: 2193 - RNA, 23 nt, Artificial Sequence
  Description of Artificial Sequence: Synthetic oligonucleotide
uuuuuuuuacagaaugugucuuu

SEQ ID NO: 2194 - RNA, 23 nt, Artificial Sequence
  Description of Artificial Sequence: Synthetic oligonucleotide
uuuuuuuuuacagaaugugucuu

SEQ ID NO: 2195 - RNA, 23 nt, Artificial Sequence
  Description of Artificial Sequence: Synthetic oligonucleotide
uuuuuuuuuacagaaugugucuu

SEQ ID NO: 2196 - RNA, 23 nt, Artificial Sequence
  Description of Artificial Sequence: Synthetic oligonucleotide
uuuuuuuuuuacagaaugugucu

SEQ ID NO: 2197 - RNA, 23 nt, Artificial Sequence
  Description of Artificial Sequence: Synthetic oligonucleotide
uuuuuuuuuuacagaaugugucu

SEQ ID NO: 2198 - RNA, 23 nt, Artificial Sequence
  Description of Artificial Sequence: Synthetic oligonucleotide
uuuuuuuuuuuacagaauguguc

SEQ ID NO: 2199 - RNA, 23 nt, Artificial Sequence
  Description of Artificial Sequence: Synthetic oligonucleotide
uuuuuuuuuuuacagaauguguc

SEQ ID NO: 2200 - RNA, 23 nt, Artificial Sequence
  Description of Artificial Sequence: Synthetic oligonucleotide
uuuuuuuuuuuuacagaaugugu

SEQ ID NO: 2201 - RNA, 23 nt, Artificial Sequence
  Description of Artificial Sequence: Synthetic oligonucleotide
uuuuuuuuuuuuacagaaugugu

SEQ ID NO: 2202 - DNA, 21 bp, Artificial Sequence
  Description of Artificial Sequence: Synthetic oligonucleotide
  Description of Combined DNA/RNA Molecule: Synthetic oligonucleotide
cuuacgcugaguacuucgatt

SEQ ID NO: 2203 - DNA, 20 bp, Artificial Sequence
  Description of Artificial Sequence: Synthetic oligonucleotide
  Description of Combined DNA/RNA Molecule: Synthetic oligonucleotide
ucgaagucucagcguaagtt

SEQ ID NO: 2204 - DNA, 24 bp, Artificial Sequence
  Description of Artificial Sequence: Synthetic oligonucleotide
ggatgggatttcatgtaaccaaga

SEQ ID NO: 2205 - DNA, 24 bp, Artificial Sequence
  Description of Artificial Sequence: Synthetic oligonucleotide
ttcatgtaaccaagagtattccat

SEQ ID NO: 2206 - RNA, 21 nt, Artificial Sequence
  Description of Artificial Sequence: Synthetic oligonucleotide
auguaaccaagaguauuccau

SEQ ID NO: 2207 - RNA, 21 nt, Artificial Sequence
  Description of Artificial Sequence: Synthetic oligonucleotide
auguaaccaagaguauuccau

SEQ ID NO: 2208 - RNA, 21 nt, Artificial Sequence
  Description of Artificial Sequence: Synthetic oligonucleotide
auguaaccaagaguauuccau

SEQ ID NO: 2209 - RNA, 21 nt, Artificial Sequence
  Description of Artificial Sequence: Synthetic oligonucleotide
ugggauuucauguaaccaaga

SEQ ID NO: 2210 - RNA, 21 nt, Artificial Sequence
  Description of Artificial Sequence: Synthetic oligonucleotide
ugggauuucauguaaccaaga

SEQ ID NO: 2211 - RNA, 21 nt, Artificial Sequence
  Description of Artificial Sequence: Synthetic oligonucleotide
ugggauuucauguaaccaaga

SEQ ID NO: 2212 - RNA, 23 nt, Artificial Sequence
  Description of Artificial Sequence: Synthetic oligonucleotide
auggaauacucuugguuacauga

SEQ ID NO: 2213 - RNA, 23 nt, Artificial Sequence
  Description of Artificial Sequence: Synthetic oligonucleotide
auggaauacucuugguuacauga

SEQ ID NO: 2214 - RNA, 23 nt, Artificial Sequence
  Description of Artificial Sequence: Synthetic oligonucleotide
auggaauacucuugguuacauga

SEQ ID NO: 2215 - RNA, 23 nt, Artificial Sequence
  Description of Artificial Sequence: Synthetic oligonucleotide
ucuugguuacaugaaaucccauc

SEQ ID NO: 2216 - RNA, 23 nt, Artificial Sequence
  Description of Artificial Sequence: Synthetic oligonucleotide
ucuugguuacaugaaaucccauc

SEQ ID NO: 2217 - RNA, 23 nt, Artificial Sequence
  Description of Artificial Sequence: Synthetic oligonucleotide
ucuugguuacaugaaaucccauc

We claim:

1. A double stranded RNAi agent comprising a sense strand complementary to an antisense strand, wherein said antisense strand comprises a sequence that is complementary to nucleotides 504 to 526 of the transthyretin (TTR) gene (SEQ ID NO:1), wherein the sense strand is 21 nucleotides in length and the antisense strand is 23 nucleotides in length, wherein said double stranded RNAi agent is represented by formula (III):

$$\text{sense: } 5'\ n_p\ \text{-}N_a\ \text{-}(X\ X\ X)_i\text{-}N_b\ \text{-}Y\ Y\ Y\ \text{-}N_b\ \text{-}(Z\ Z\ Z)_j\text{-}N_a\text{-}n_q\ 3'$$

$$\text{antisense: } 3'\ n_p'\text{-}N_a'\text{-}(X'X'X')_k\text{-}N_b'\text{-}Y'Y'Y'\text{-}N_b'\text{-}(Z'Z'Z')_l\text{-}N_a'\text{-}n_q'\ 5'$$

wherein:
j=1; and i, k, and l are 0;
p' is 2; p, q, and q' are 0;
each $N_a$ and $N_a'$ independently represents an oligonucleotide sequence comprising 2-10 nucleotides which are modified nucleotides;

each $N_b$ and $N_b'$ independently represents an oligonucleotide sequence comprising 0-7 nucleotides which are modified nucleotides;

$n_p'$ represents an overhang nucleotide;

YYY, ZZZ, and Y'Y'Y', each independently represent one motif of three identical modifications on three consecutive nucleotides, wherein the Y nucleotides contain a 2'-fluoro modification, the Y' nucleotides contain a 2'-O-methyl modification, and the Z nucleotides contain a 2'-O-methyl modification; and wherein the sense strand is conjugated to at least one ligand, wherein the ligand is one or more GalNAc derivatives attached through a bivalent or trivalent branched linker.

2. The RNAi agent of claim 1, wherein the YYY motif occurs at or near the cleavage site of the sense strand; or wherein the Y'Y'Y' motif occurs at the 11, 12 and 13 positions of the antisense strand from the 5'-end.

3. The RNAi agent of claim 1, wherein the modifications on the $N_a$, $N_a'$, $N_b$ and $N_b'$ nucleotides are each independently selected from the group consisting of LNA, HNA, CeNA, 2'-methoxyethyl, 2'-O-alkyl, 2'-O-allyl, 2'-C-allyl, 2'-fluoro, 2'-deoxy, 2'-hydroxyl, and combinations thereof.

4. The RNAi agent of claim 3, wherein the modifications on the $N_a$, $N_a'$, $N_b$ and $N_b'$ nucleotides are 2'-O-methyl, 2'-fluoro or both.

5. The RNAi agent of claim 1, wherein the ligand is

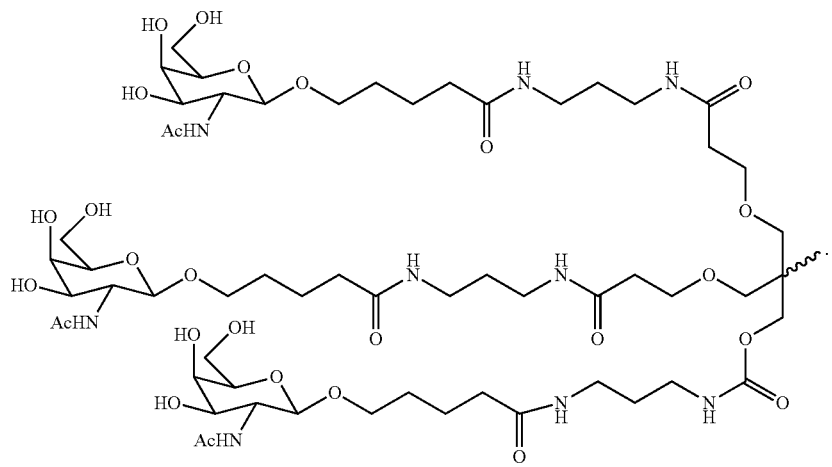 [SMILES: CC(=O)NC1C(OCCCCC(=O)NCCCNC(=O)CCOCC(C)(COCCC(=O)NCCCNC(=O)CCCCOC2OC(CO)C(O)C(O)C2NC(C)=O)COC(=O)NCCCNC(=O)CCCCOC2OC(CO)C(O)C(O)C2NC(C)=O)OC(CO)C(O)C1O]

6. The RNAi agent of claim 1, wherein the ligand is attached to the 3' end of the sense strand.

7. The RNAi agent of claim 6, wherein the RNAi agent is conjugated to the ligand as shown in the following schematic

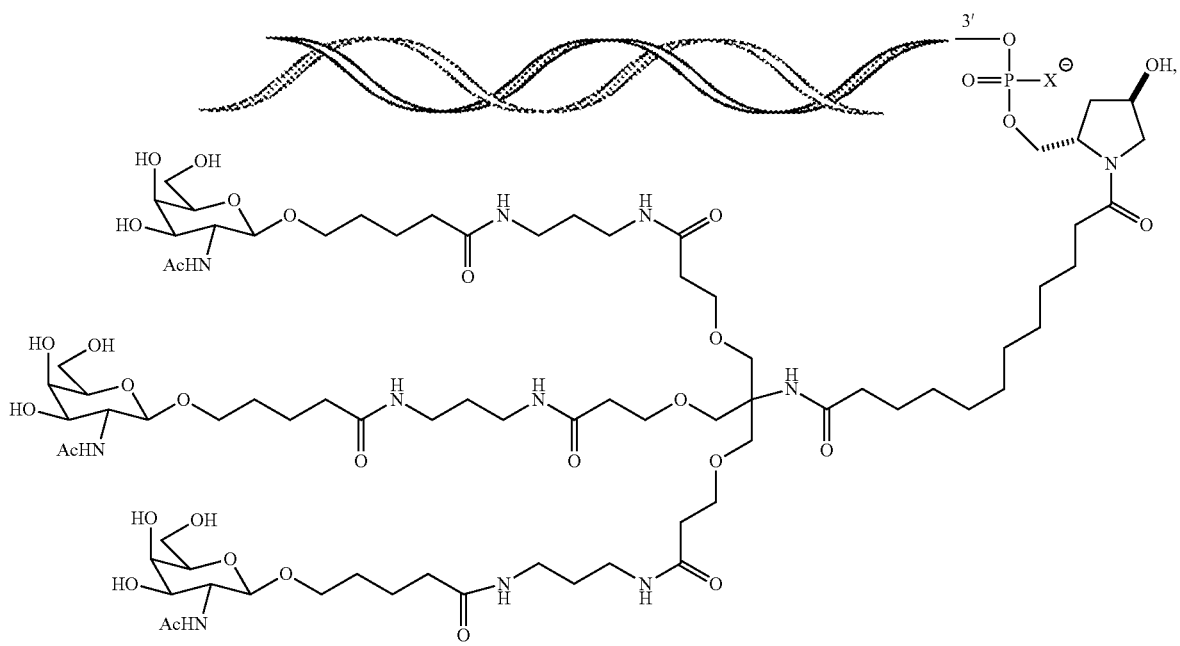

wherein X is O or S.

8. The RNAi agent of claim 7, wherein the RNAi agent is conjugated to the ligand as shown in the following schematic comprises the nucleotide sequence 5'-uCfuUfgGfUfUfaC-faugAfaAfuCfcCfasUfsc-3' (SEQ ID NO:3),

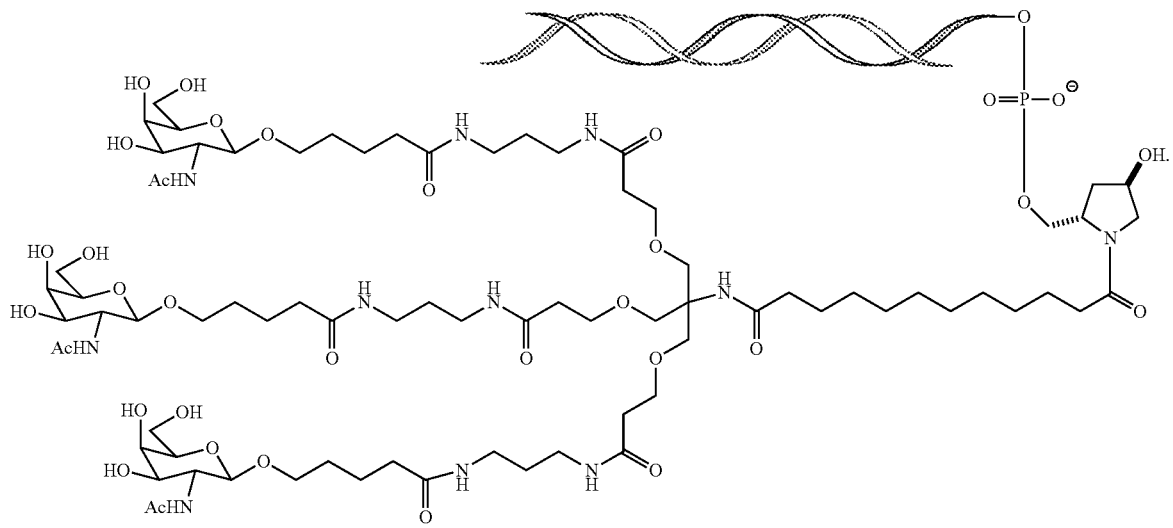 [SMILES: COP(=O)([O-])OC[C@@H]1C[C@@H](O)CN1C(=O)CCCCCCCCCCC(=O)NC(COCCC(=O)NCCCNC(=O)CCCCOC1OC(CO)C(O)C(O)C1NC(C)=O)(COCCC(=O)NCCCNC(=O)CCCCOC1OC(CO)C(O)C(O)C1NC(C)=O)COCCC(=O)NCCCNC(=O)CCCCOC1OC(CO)C(O)C(O)C1NC(C)=O]

9. The RNAi agent of claim 1 further comprising at least one phosphorothioate or methylphosphonate internucleotide linkage.

10. The RNAi agent of claim 9, wherein the phosphorothioate or methylphosphonate internucleotide linkage is at the 3'-terminal of one strand.

11. The RNAi agent of claim 10, wherein said strand is the antisense strand or the sense strand.

12. The RNAi agent of claim 1, wherein the base pair at the 1 position of the 5'-end of the antisense strand of the duplex is an AU base pair.

13. The RNAi agent of claim 1, wherein the p' overhang nucleotides are complementary to the target mRNA or wherein the p' overhang nucleotides are non-complementary to the target mRNA.

14. The RNAi agent of claim 1, wherein at least one np' is linked to a neighboring nucleotide via a phosphorothioate linkage.

15. The RNAi agent of claim 14, wherein all np' are linked to neighboring nucleotides via phosphorothioate linkages.

16. The RNAi agent of claim 1, wherein said RNAi agent is selected from the group consisting of AD-51546 and AD-51547.

17. The RNAi agent of claim 1, wherein the RNAi agent is AD-51547.

18. The double stranded RNAi agent of claim 1, wherein the sense strand comprises the nucleotide sequence 5'-UGGGAUUUCAUGUAACCAAGA-3' (SEQ ID NO:2211).

19. The double stranded RNAi agent of claim 1, wherein the sense strand comprises the nucleotide sequence 5'-UfgG-fgAfuUfuCfAfUfgUfaacCfaAfgAfL96-3' (SEQ ID NO:2) and the antisense strand comprises the nucleotide sequence 5'-uCfuUfgGfUfUfaCfaugAfaAfuCfcCfasUfsc-3' (SEQ ID NO:3), wherein a, g, c and u are 2'-O-methyl (2'-OMe) A, G, C, and U; Af, Gf, Cf, and Uf are 2'-fluoro A, G, C and U; s is a phosphorothioate linkage; and L96 is a GalNAc3 ligand.

20. A double stranded RNAi agent, comprising a sense strand and an antisense strand, wherein the sense strand comprises the nucleotide sequence 5'-UfgGfgAfuUfuCfAfUfgU-faacCfaAfgAfL96-3' (SEQ ID NO:2) and the antisense strand comprises the nucleotide sequence 5'-uCfuUfgGfUfUfaC-faugAfaAfuCfcCfasUfsc-3' (SEQ ID NO:3), wherein a, g, c, and u are 2'-O-methyl (2'-OMe) A, G, C, and U; Af, Gf, Cf, and Uf are 2'-fluoro A, G, C, and U; s is a phosphorothioate linkage; and L96 is a GalNAc3 ligand.

21. An isolated cell containing an RNAi agent of any one of claims 1, 17, or 20.

22. A pharmaceutical composition comprising an RNAi agent of any one of claims 1, 17, or 20.

23. The pharmaceutical composition of claim 22, wherein the RNAi agent is administered in an unbuffered solution.

24. The pharmaceutical composition of claim 23, wherein said unbuffered solution is saline or water.

25. The pharmaceutical composition of claim 22, wherein said RNAi agent is administered with a buffer solution.

26. The pharmaceutical composition of claim 25, wherein said buffer solution comprises acetate, citrate, prolamine, carbonate, or phosphate or any combination thereof.

27. The pharmaceutical composition of claim 26, wherein said buffer solution is phosphate buffered saline (PBS).

28. A method of inhibiting expression of a transthyretin (TTR) in a cell comprising contacting said cell with an RNAi agent of any one of claims 1, 17, or 20 in an amount effective to inhibit expression of said TTR in said cell, thereby inhibiting expression of said transthyretin (TTR) in said cell.

29. A kit for performing the method of claim 28, comprising
a) said RNAi agent, and
b) instructions for use.

30. A method of treating a TTR-associated disease in a subject, comprising administering to said subject a therapeutically effective amount of an RNAi agent of any one of claims 1, 17, or 20, thereby treating said TTR-associated disease in said subject.

31. The method of claim 30, wherein said subject is a human.

32. The method of claim 30, wherein said subject carries a TTR gene mutation that is associated with the development of a TTR-associated disease.

33. The method of claim 30, wherein said TTR-associated disease is selected from the group consisting of senile systemic amyloidosis (SSA), systemic familial amyloidosis, familial amyloidotic polyneuropathy (FAP), familial amyloidotic cardiomyopathy (FAC), leptomeningeal/Central Nervous System (CNS) amyloidosis, and hyperthyroxinemia.

36. The method of claim 30, wherein said subject has a TTR-associated amyloidosis and said method reduces an amyloid TTR deposit in said subject.

35. The method of claim 30, wherein said RNAi agent is administered to the subject subcutaneously.

36. A kit for performing the method of claim 30, comprising
  a) said RNAi agent,
  b) instructions for use, and
  c) optionally, means for administering said RNAi agent to said subject.

* * * * *